(12) United States Patent
Tan et al.

(10) Patent No.: US 11,845,797 B2
(45) Date of Patent: Dec. 19, 2023

(54) ANTI-TCR ANTIBODY MOLECULES AND USES THEREOF

(71) Applicant: Marengo Therapeutics, Inc., Cambridge, MA (US)

(72) Inventors: Seng-Lai Tan, Cambridge, MA (US); Brian Edward Vash, Cambridge, MA (US); Jonathan Hsu, Cambridge, MA (US); Dilini Charmain Gunasekera, Cambridge, MA (US); Sangeetha Sagar Palakurthi, Cambridge, MA (US); Andreas Loew, Cambridge, MA (US)

(73) Assignee: Marengo Therapeutics, Inc., Cambridge, MA (US)

( * ) Notice: Subject to any disclaimer, the term of this patent is extended or adjusted under 35 U.S.C. 154(b) by 360 days.

(21) Appl. No.: 17/256,917

(22) PCT Filed: Jul. 3, 2019

(86) PCT No.: PCT/US2019/040592
§ 371 (c)(1),
(2) Date: Dec. 29, 2020

(87) PCT Pub. No.: WO2020/010250
PCT Pub. Date: Jan. 9, 2020

(65) Prior Publication Data
US 2021/0277119 A1 Sep. 9, 2021

Related U.S. Application Data

(60) Provisional application No. 62/808,700, filed on Feb. 21, 2019, provisional application No. 62/788,674, filed on Jan. 4, 2019, provisional application No. 62/737,829, filed on Sep. 27, 2018, provisional application No. 62/693,653, filed on Jul. 3, 2018.

(51) Int. Cl.
| | |
|---|---|
| *C07K 16/28* | (2006.01) |
| *A61P 35/00* | (2006.01) |
| *A61K 35/17* | (2015.01) |
| *C12N 5/078* | (2010.01) |
| *A61K 39/00* | (2006.01) |

(52) U.S. Cl.
CPC .......... *C07K 16/2809* (2013.01); *A61K 35/17* (2013.01); *A61P 35/00* (2018.01); *C07K 16/2803* (2013.01); *C07K 16/283* (2013.01); *C07K 16/2878* (2013.01); *C12N 5/0634* (2013.01); *A61K 2039/505* (2013.01); *C07K 2317/24* (2013.01); *C07K 2317/31* (2013.01); *C07K 2317/55* (2013.01); *C07K 2317/622* (2013.01); *C07K 2317/92* (2013.01)

(58) Field of Classification Search
CPC ............ C07K 16/2809; C07K 16/2803; C07K 16/283; C07K 16/2878; C07K 2317/24; C07K 2317/31; C07K 2317/55; C07K 2317/622; C07K 2317/92; A61K 35/17; A61K 2039/505; A61P 35/00; C12N 5/0634

See application file for complete search history.

(56) References Cited

U.S. PATENT DOCUMENTS

| | | |
|---|---|---|
| 861,745 A | 7/1907 | Maxwell |
| 4,816,567 A | 3/1989 | Cabilly et al. |
| 5,223,409 A | 6/1993 | Ladner et al. |
| 5,225,539 A | 7/1993 | Winter |
| 5,585,089 A | 12/1996 | Queen et al. |
| 5,624,821 A | 4/1997 | Winter et al. |
| 5,648,260 A | 7/1997 | Winter et al. |
| 5,693,761 A | 12/1997 | Queen et al. |
| 5,693,762 A | 12/1997 | Queen et al. |
| 5,731,116 A | 3/1998 | Matsuo et al. |
| 5,811,097 A | 9/1998 | Allison et al. |
| 5,831,012 A | 11/1998 | Nilsson et al. |
| 5,861,155 A | 1/1999 | Lin |
| 6,172,197 B1 | 1/2001 | McCafferty et al. |
| 6,291,158 B1 | 9/2001 | Winter et al. |
| 6,352,694 B1 | 3/2002 | June et al. |

(Continued)

FOREIGN PATENT DOCUMENTS

| | | |
|---|---|---|
| EP | 0125023 A1 | 11/1984 |
| EP | 0171496 A2 | 2/1986 |

(Continued)

OTHER PUBLICATIONS

Geissinger et al. Identification of the Tumor Cells in Peripheral T-Cell Lymphomas by Combined Polymerase Chain Reaction-Based T-Cell Receptor β Spectrotyping and Immunohistological Detection with T-Cell Receptor β Chain Variable Region Segment-Specific Antibodies, 2005, J.of Mol Diag, 7, 4, 455-464 (Year: 2005).*

(Continued)

*Primary Examiner* — Adam Weidner
*Assistant Examiner* — Brittney E Donoghue
(74) *Attorney, Agent, or Firm* — Wilson Sonsini Goodrich & Rosati

(57) ABSTRACT

The disclosure provides antibody molecules that bind to TCR Vβ regions and multispecific molecules comprising said antibody molecules. Additionally, disclosed are nucleic acids encoding the same, methods of producing the aforesaid molecules, pharmaceutical compositions comprising aforesaid molecules, and methods of treating a cancer using the aforesaid molecules.

34 Claims, 97 Drawing Sheets

Specification includes a Sequence Listing.

(56) References Cited

U.S. PATENT DOCUMENTS

| | | |
|---|---|---|
| 6,534,055 B1 | 3/2003 | June et al. |
| 6,582,915 B1 | 6/2003 | Griffiths et al. |
| 6,593,081 B1 | 7/2003 | Griffiths et al. |
| 6,696,245 B2 | 2/2004 | Winter et al. |
| 6,765,087 B1 | 7/2004 | Casterman et al. |
| 6,818,418 B1 | 11/2004 | Lipovsek et al. |
| 6,838,254 B1 | 1/2005 | Hamers et al. |
| 7,083,785 B2 | 8/2006 | Browning et al. |
| 7,105,149 B1 | 9/2006 | Dalla-Favera |
| 7,183,076 B2 | 2/2007 | Arathoon et al. |
| 7,186,804 B2 | 3/2007 | Gillies et al. |
| 7,276,241 B2 | 10/2007 | Schneider et al. |
| 7,402,314 B2 | 7/2008 | Sherman |
| 7,431,380 B1 | 10/2008 | Buresh |
| 7,476,724 B2 | 1/2009 | Dennis et al. |
| 7,501,121 B2 | 3/2009 | Tchistiakova et al. |
| 7,642,228 B2 | 1/2010 | Carter et al. |
| 7,700,739 B2 * | 4/2010 | Lacy ............... A61P 13/12 424/130.1 |
| 7,741,446 B2 | 6/2010 | Pardridge et al. |
| 7,750,128 B2 | 7/2010 | Gegg et al. |
| 7,767,429 B2 | 8/2010 | Bookbinder et al. |
| 7,799,902 B2 | 9/2010 | Browning et al. |
| 7,807,160 B2 * | 10/2010 | Presta ............... A61P 43/00 424/133.1 |
| 7,855,275 B2 | 12/2010 | Eigenbrot et al. |
| 7,919,257 B2 | 4/2011 | Hoogenboom et al. |
| 7,943,743 B2 | 5/2011 | Korman et al. |
| 7,999,077 B2 | 8/2011 | Pastan et al. |
| 8,003,774 B2 | 8/2011 | Stavenhagen et al. |
| 8,008,449 B2 | 8/2011 | Korman et al. |
| 8,012,465 B2 | 9/2011 | Elias et al. |
| 8,202,517 B2 | 6/2012 | Bookbinder et al. |
| 8,216,805 B2 | 7/2012 | Carter et al. |
| 8,227,577 B2 | 7/2012 | Klein et al. |
| 8,299,220 B2 | 10/2012 | Dalla-Favera |
| 8,362,213 B2 | 1/2013 | Elkins et al. |
| 8,450,470 B2 | 5/2013 | Bookbinder et al. |
| 8,466,260 B2 | 6/2013 | Elkins et al. |
| 8,552,156 B2 | 10/2013 | Takayanagi et al. |
| 8,580,252 B2 | 11/2013 | Bookbinder et al. |
| 8,586,713 B2 | 11/2013 | Davis et al. |
| 8,592,562 B2 | 11/2013 | Kannan et al. |
| 8,609,089 B2 | 12/2013 | Langermann et al. |
| 8,617,559 B2 | 12/2013 | Elkins et al. |
| 8,703,132 B2 | 4/2014 | Imhof-Jung et al. |
| 8,772,246 B2 | 7/2014 | Bookbinder et al. |
| 8,821,883 B2 | 9/2014 | Ambrose et al. |
| 8,846,042 B2 | 9/2014 | Zhou |
| 8,871,912 B2 | 10/2014 | Davis et al. |
| 8,920,776 B2 | 12/2014 | Gaiger et al. |
| 8,945,571 B2 | 2/2015 | Mossner et al. |
| 9,000,130 B2 | 4/2015 | Bhakta et al. |
| 9,034,324 B2 | 5/2015 | Kalled et al. |
| 9,056,905 B2 | 6/2015 | Olson et al. |
| 9,145,588 B2 | 9/2015 | Throsby et al. |
| 9,200,060 B2 | 12/2015 | Kannan et al. |
| 9,243,058 B2 | 1/2016 | Armitage et al. |
| 9,309,311 B2 | 4/2016 | Gurney et al. |
| 9,340,621 B2 | 5/2016 | Kufer et al. |
| 9,358,286 B2 | 6/2016 | De et al. |
| 9,359,437 B2 | 6/2016 | Davis et al. |
| 9,382,323 B2 | 7/2016 | Brinkmann et al. |
| 9,387,237 B2 | 7/2016 | Kalled et al. |
| 9,447,159 B2 | 9/2016 | Ast et al. |
| 9,545,086 B2 | 1/2017 | MacKay et al. |
| 10,610,571 B2 | 4/2020 | Ptacin et al. |
| 10,676,516 B2 | 6/2020 | Viney et al. |
| 2002/0115214 A1 | 8/2002 | June et al. |
| 2004/0009530 A1 | 1/2004 | Wilson et al. |
| 2004/0175756 A1 | 9/2004 | Kolkman et al. |
| 2005/0048512 A1 | 3/2005 | Kolkman et al. |
| 2005/0053973 A1 | 3/2005 | Kolkman et al. |
| 2006/0008844 A1 | 1/2006 | Stemmer et al. |
| 2007/0036783 A1 | 2/2007 | Humeau et al. |
| 2008/0069820 A1 | 3/2008 | Fuh et al. |
| 2008/0247944 A1 | 10/2008 | Graziano et al. |
| 2009/0214533 A1 | 8/2009 | Clynes |
| 2010/0015133 A1 | 1/2010 | Igawa et al. |
| 2010/0028330 A1 | 2/2010 | Collins et al. |
| 2010/0168393 A1 | 7/2010 | Clube et al. |
| 2010/0316645 A1 | 12/2010 | Imhof-Jung et al. |
| 2011/0014659 A1 | 1/2011 | Balazs et al. |
| 2011/0054151 A1 | 3/2011 | Lazar et al. |
| 2011/0091372 A1 | 4/2011 | Ghayur et al. |
| 2011/0150892 A1 | 6/2011 | Thudium et al. |
| 2011/0177073 A1 | 7/2011 | Van Berkel et al. |
| 2011/0177093 A1 | 7/2011 | Kalled et al. |
| 2011/0250170 A1 | 10/2011 | Pedretti et al. |
| 2011/0287056 A1 | 11/2011 | Gu et al. |
| 2011/0293613 A1 | 12/2011 | Brinkmann et al. |
| 2012/0039906 A1 | 2/2012 | Olive |
| 2012/0114649 A1 | 5/2012 | Langermann et al. |
| 2012/0149876 A1 | 6/2012 | Von Kreudenstein et al. |
| 2012/0184716 A1 | 7/2012 | Fischer et al. |
| 2012/0201746 A1 | 8/2012 | Liu et al. |
| 2012/0213768 A1 | 8/2012 | Oh et al. |
| 2013/0017200 A1 | 1/2013 | Scheer et al. |
| 2013/0022601 A1 | 1/2013 | Brinkmann et al. |
| 2013/0078249 A1 | 3/2013 | Ast et al. |
| 2013/0129723 A1 | 5/2013 | Blankenship et al. |
| 2013/0165638 A1 | 6/2013 | Hsu et al. |
| 2013/0178605 A1 | 7/2013 | Blein et al. |
| 2013/0195849 A1 | 8/2013 | Spreter Von Kreudenstein et al. |
| 2013/0243775 A1 | 9/2013 | Papadopoulos et al. |
| 2013/0266568 A1 | 10/2013 | Brinkmann et al. |
| 2013/0267686 A1 | 10/2013 | Brinkmann et al. |
| 2013/0273055 A1 | 10/2013 | Borges et al. |
| 2013/0303396 A1 | 11/2013 | Igawa et al. |
| 2013/0317200 A1 | 11/2013 | Elson et al. |
| 2014/0037621 A1 | 2/2014 | Tsurushita et al. |
| 2014/0044728 A1 | 2/2014 | Takayanagi et al. |
| 2014/0051833 A1 | 2/2014 | Fischer et al. |
| 2014/0051835 A1 | 2/2014 | Dixit et al. |
| 2014/0072528 A1 | 3/2014 | Gerdes et al. |
| 2014/0072581 A1 | 3/2014 | Dixit et al. |
| 2014/0079689 A1 | 3/2014 | Elliott et al. |
| 2014/0154254 A1 | 6/2014 | Kannan et al. |
| 2014/0199294 A1 | 7/2014 | Mimoto et al. |
| 2014/0200331 A1 | 7/2014 | Corper et al. |
| 2014/0242075 A1 | 8/2014 | Parren et al. |
| 2014/0242077 A1 | 8/2014 | Choi et al. |
| 2014/0308285 A1 | 10/2014 | Yan et al. |
| 2014/0322212 A1 | 10/2014 | Brogdon et al. |
| 2014/0322221 A1 | 10/2014 | Miller et al. |
| 2014/0348839 A1 | 11/2014 | Chowdhury et al. |
| 2014/0363426 A1 | 12/2014 | Moore et al. |
| 2014/0377269 A1 | 12/2014 | Mabry et al. |
| 2015/0017187 A1 | 1/2015 | Thanos et al. |
| 2015/0018529 A1 | 1/2015 | Humphreys et al. |
| 2015/0098900 A1 | 4/2015 | Ebens et al. |
| 2015/0133638 A1 | 5/2015 | Wranik et al. |
| 2015/0166661 A1 | 6/2015 | Chen et al. |
| 2015/0166670 A1 | 6/2015 | Castoldi et al. |
| 2015/0175707 A1 | 6/2015 | De Jong et al. |
| 2015/0203591 A1 | 7/2015 | Yancopoulos et al. |
| 2015/0211001 A1 | 7/2015 | Ohrn et al. |
| 2015/0218260 A1 | 8/2015 | Klein et al. |
| 2015/0232560 A1 | 8/2015 | Heindl et al. |
| 2015/0315296 A1 | 11/2015 | Schaefer et al. |
| 2015/0337049 A1 | 11/2015 | Labrijn et al. |
| 2015/0344570 A1 | 12/2015 | Igawa et al. |
| 2015/0353636 A1 | 12/2015 | Parren et al. |
| 2015/0368351 A1 | 12/2015 | Vu et al. |
| 2015/0368352 A1 | 12/2015 | Liu |
| 2015/0376287 A1 | 12/2015 | Vu et al. |
| 2016/0015749 A1 | 1/2016 | Gottschalk et al. |
| 2016/0039947 A1 | 2/2016 | Demarest et al. |
| 2016/0075785 A1 | 3/2016 | Ast et al. |
| 2016/0102135 A1 | 4/2016 | Escobar-Cabrera |
| 2016/0114057 A1 | 4/2016 | Dixit et al. |
| 2016/0130347 A1 | 5/2016 | Bruenker et al. |
| 2016/0131654 A1 | 5/2016 | Berenson et al. |
| 2016/0145340 A1 | 5/2016 | Borges et al. |

(56) References Cited

U.S. PATENT DOCUMENTS

| | | |
|---|---|---|
| 2016/0176973 A1 | 6/2016 | Kufer et al. |
| 2016/0194389 A1 | 7/2016 | Regula et al. |
| 2016/0229915 A1 | 8/2016 | Igawa et al. |
| 2016/0257763 A1 | 9/2016 | Von Kreudenstein et al. |
| 2016/0264685 A1 | 9/2016 | Fouque et al. |
| 2016/0297885 A1 | 10/2016 | Kuo et al. |
| 2016/0311915 A1 | 10/2016 | Puléet al. |
| 2016/0368985 A1 | 12/2016 | Hotzel et al. |
| 2016/0368988 A1 | 12/2016 | Bakker et al. |
| 2017/0022284 A1 | 1/2017 | Timmer et al. |
| 2017/0037128 A1 | 2/2017 | Little et al. |
| 2017/0051068 A1 | 2/2017 | Pillarisetti et al. |
| 2017/0204176 A1 | 7/2017 | Bonvini et al. |
| 2018/0256716 A1 | 9/2018 | Schendel et al. |
| 2019/0062448 A1 | 2/2019 | Soros et al. |
| 2019/0315883 A1 | 10/2019 | Ast et al. |
| 2019/0322763 A1 | 10/2019 | Ast et al. |
| 2020/0172591 A1 | 6/2020 | Hosse et al. |
| 2020/0230208 A1 | 7/2020 | Wang et al. |
| 2020/0299349 A1 | 9/2020 | Garcia et al. |
| 2020/0306301 A1 | 10/2020 | Andresen et al. |
| 2020/0308242 A1 | 10/2020 | Lowe et al. |
| 2020/0317787 A1 | 10/2020 | Li et al. |
| 2021/0024631 A1 | 1/2021 | Kley et al. |
| 2022/0064297 A1 | 3/2022 | Tan et al. |

FOREIGN PATENT DOCUMENTS

| | | | |
|---|---|---|---|
| EP | 0173494 | A2 | 3/1986 |
| EP | 0184187 | A2 | 6/1986 |
| EP | 0368684 | A1 | 5/1990 |
| EP | 0388151 | A1 | 9/1990 |
| EP | 0616640 | A1 | 9/1994 |
| EP | 0403156 | B1 | 9/1997 |
| EP | 1870459 | A1 | 12/2007 |
| EP | 2581113 | A1 | 4/2013 |
| EP | 1846020 | B1 | 8/2013 |
| EP | 2699259 | A1 | 2/2014 |
| EP | 2467165 | B1 | 1/2015 |
| EP | 2847231 | A1 | 3/2015 |
| EP | 2982694 | A1 | 2/2016 |
| EP | 3023437 | A1 | 5/2016 |
| EP | 3029068 | A1 | 6/2016 |
| EP | 3055329 | A1 | 8/2016 |
| EP | 3137500 | A1 | 3/2017 |
| EP | 3059246 | B1 | 7/2018 |
| EP | 2723380 | B1 | 8/2019 |
| EP | 3626739 | A1 | 3/2020 |
| EP | 3642228 | A1 | 4/2020 |
| EP | 3189132 | B1 | 6/2020 |
| GB | 2188638 | A | 10/1987 |
| WO | WO-8500817 | A1 | 2/1985 |
| WO | WO-8601533 | A1 | 3/1986 |
| WO | WO-8702671 | A1 | 5/1987 |
| WO | WO-9002809 | A1 | 3/1990 |
| WO | WO-9100906 | A1 | 1/1991 |
| WO | WO-9110741 | A1 | 7/1991 |
| WO | WO-9117271 | A1 | 11/1991 |
| WO | WO-9201047 | A1 | 1/1992 |
| WO | WO-9203917 | A1 | 3/1992 |
| WO | WO-9203918 | A1 | 3/1992 |
| WO | WO-9209690 | A2 | 6/1992 |
| WO | WO-9215679 | A1 | 9/1992 |
| WO | WO-9218619 | A1 | 10/1992 |
| WO | WO-9220791 | A1 | 11/1992 |
| WO | WO-9301288 | A1 | 1/1993 |
| WO | WO-9311236 | A1 | 6/1993 |
| WO | WO-9404678 | A1 | 3/1994 |
| WO | WO-9405801 | A1 | 3/1994 |
| WO | WO-9509917 | A1 | 4/1995 |
| WO | WO-9516038 | A2 | 6/1995 |
| WO | WO-9856915 | A2 | 12/1998 |
| WO | WO-9904820 | A2 | 2/1999 |
| WO | WO-9916873 | A1 | 4/1999 |
| WO | WO-9945110 | A1 | 9/1999 |
| WO | WO-0034784 | A1 | 6/2000 |
| WO | WO-0060070 | A1 | 10/2000 |
| WO | WO-0104144 | A2 | 1/2001 |
| WO | WO-0164942 | A1 | 9/2001 |
| WO | WO-03002609 | A2 | 1/2003 |
| WO | WO-2004003019 | A2 | 1/2004 |
| WO | WO-2004056873 | A1 | 7/2004 |
| WO | WO-2004058821 | A2 | 7/2004 |
| WO | WO-2004081026 | A2 | 9/2004 |
| WO | WO-2004101790 | A1 | 11/2004 |
| WO | WO-2004106368 | A1 | 12/2004 |
| WO | WO-2005035572 | A2 | 4/2005 |
| WO | WO-2006079372 | A1 | 8/2006 |
| WO | WO-2006121168 | A1 | 11/2006 |
| WO | WO-2007005874 | A2 | 1/2007 |
| WO | WO-2007059782 | A1 | 5/2007 |
| WO | WO-2009089004 | A1 | 7/2009 |
| WO | WO-2009101611 | A1 | 8/2009 |
| WO | WO-2009114335 | A2 | 9/2009 |
| WO | WO-2010019570 | A2 | 2/2010 |
| WO | WO-2010027797 | A1 | 3/2010 |
| WO | WO-2010027827 | A2 | 3/2010 |
| WO | WO-2010077634 | A1 | 7/2010 |
| WO | WO-2011066342 | A2 | 6/2011 |
| WO | WO-2011155607 | A1 | 12/2011 |
| WO | WO-2012107417 | A1 | 8/2012 |
| WO | WO-2012143498 | A1 | 10/2012 |
| WO | WO-2013079174 | A1 | 6/2013 |
| WO | WO-2013170168 | A1 | 11/2013 |
| WO | WO-2014008218 | A1 | 1/2014 |
| WO | WO-2015052230 | A1 | 4/2015 |
| WO | WO-2015107015 | A1 | 7/2015 |
| WO | WO-2015107025 | A1 | 7/2015 |
| WO | WO-2015107026 | A1 | 7/2015 |
| WO | WO-2015127158 | A1 | 8/2015 |
| WO | WO-2015166073 | A1 | 11/2015 |
| WO | WO-2015181805 | A1 | 12/2015 |
| WO | WO-2015197582 | A1 | 12/2015 |
| WO | WO-2015197598 | A2 | 12/2015 |
| WO | WO-2016016299 | A1 | 2/2016 |
| WO | WO-2016026943 | A1 | 2/2016 |
| WO | WO-2016071376 | A2 | 5/2016 |
| WO | WO-2016071377 | A1 | 5/2016 |
| WO | WO-2016079081 | A1 | 5/2016 |
| WO | WO-2016087416 | A1 | 6/2016 |
| WO | WO-2016087514 | A1 | 6/2016 |
| WO | WO-2016087650 | A1 | 6/2016 |
| WO | WO-2016090327 | A2 | 6/2016 |
| WO | WO-2016110584 | A1 | 7/2016 |
| WO | WO-2016115274 | A1 | 7/2016 |
| WO | WO-2016118641 | A1 | 7/2016 |
| WO | WO-2016168149 | A1 | 10/2016 |
| WO | WO-2016180969 | A1 | 11/2016 |
| WO | WO-2016193301 | A1 | 12/2016 |
| WO | WO-2017021450 | A1 | 2/2017 |
| WO | WO-2017077382 | A1 | 5/2017 |
| WO | WO-2017165464 | A1 | 9/2017 |
| WO | WO-2018057955 | A1 | 3/2018 |
| WO | WO-2018098365 | A2 | 5/2018 |
| WO | WO-2018237192 | A1 | 12/2018 |
| WO | WO-2019005641 | A1 | 1/2019 |
| WO | WO-2019086865 | A1 | 5/2019 |
| WO | WO-2019101695 | A1 | 5/2019 |
| WO | WO-2019132738 | A1 | 7/2019 |
| WO | WO-2019158764 | A1 | 8/2019 |
| WO | WO-2019178362 | A1 | 9/2019 |
| WO | WO-2019191519 | A1 | 10/2019 |
| WO | WO-2019231920 | A1 | 12/2019 |
| WO | WO-2020005819 | A1 | 1/2020 |
| WO | WO-2020010250 | A2 | 1/2020 |
| WO | WO-2020057646 | A1 | 3/2020 |
| WO | WO-2020082048 | A1 | 4/2020 |
| WO | WO-2020086758 | A1 | 4/2020 |
| WO | WO-2020088459 | A1 | 5/2020 |
| WO | WO-2020091635 | A2 | 5/2020 |
| WO | WO-2020106708 | A1 | 5/2020 |
| WO | WO-2020139171 | A1 | 7/2020 |

(56) References Cited

FOREIGN PATENT DOCUMENTS

| WO | WO-2020139175 A2 | 7/2020 |
|---|---|---|
| WO | WO-2020183245 A2 | 9/2020 |

OTHER PUBLICATIONS

Scheuermann and Racila, CD19 antigen in leukemia and lymphoma diagnosis and immunotherapy, 1995, Leukemia & Lymphoma, vol. 18, Abstract (Year: 1995).*
"Salameire, et al., "Accurate detection of the tumor clone in peripheral T-cell lymphoma biopsies by flow cytometric analysis of tCR-V B repertoire" Modern Pathology (2012) 25, p. 1246-1257".
"Aversa, et al., "Molecular T-Cell Repertoire Analysis as Source of Prognostic and Predictive biomarkers for Checkpoint blockade Immunotherapy" International Journal of Molecular Sciences (2020), 21, 2378, p. 1-19".
"Banerjee, et al., 33rd annual Meeting & Pre-Conference Programs of the Society for Immunotherapy of Cancer (SITC) 2018 p. 1-192".
"Cui, et al., "T cell receptor B-chain repertoire analysis of tumor-inflitrating lymphocytes in pancreatic cancer" Cancer Science (2018) 60-71".
"Duhen, et al., "Co-expression of CD39 and CD103 identifies tumor-reactive CD8 T cells in human solid tumors" Nature Communications (2018) 9:2724, p. 1-13".
"Fernandez-Malave, et al., "An natural anti-T-cell receptor monoclonal antibody protects against experimental autoimmune encephalomyelitis" Journal of Neuroimmunology 234 (2011) 63-70".
"Green, et al., "TCR validation toward gene therapy for cancer" (2019) Methods in Enzymology, vol. 629 chapter 21, p. 419-439".
"Islam, et al., "changes in the Peripheral blood T-Cell Receptor VB Repertoire In vivo and In Vitro during Shigellosis" Infection and Immunity (1996), Vo. 64, No. 4, p. 1391-1399".
"Kanagawa, et al., "In Vivo T Cell Tumor TherapyWith Monoclonal Antibody Directed to the VB chain of T Cell Antigen Receptor" J. Exp. Med., vol. 170, (1989) p. 1513-1519".
"Kanagawa, et al., "The T Cell Receptor VB6 Domain Imparts Reactivity to the Mls-1a Antigen" Cellular Immunology 119, 412-426 (1989)".
"Kitaura, et al., "A new High-throughput sequencing method for determining diversity and similarity of T cell receptor (TCR) a and B repertoires and identifying potential new invariant TCR a chains" (2016) p. 1-16".
"Li, et al., "Landscape of tumor-inflitrating T cell repertoire of human cancers" (2016) Nature Genetics, vol. 48, No. 7, p. 725-735".
"Lou, et al., "Worldwide genetic variation of the IGHV and TRBV immune receptor gene families in humans" (2019) Life Science Alliance vol. 2, No. 2 p. 1-9".
"Luo, et al., "Worlwide genetic variation of the IGHV and TRBV immune receptor gene families in humans" (2019) Life Sciences Alliance, vol. 2, No. 2, p. 1-9".
"No Author "PE anti-human TCR VB23 Antibody" (2012)".
"No Author "PE anti-mouse TCR VB6 Antibody" (2012)".
"Oh, et al., "Single variable domains from the T cell receptor B chain function as mono-and bifunctional CARs and TCRs" Scientific Reports (2019) p. 1-12".
"Page, et al., "Deep Sequencing of T-cell Receptor DNA as a biomarker of Clonally Expanded TILs in Breast Cancer after Immunotherapy" (2016) Cancer Immunolo Res 4: pp. 835-844".
"Paul, et al., "TCR beta chain-directed bispecific antibodies for the treatment of T-cell cancers" Science Translation Medicine (2021) p. 1-21".
"Payne, et al., "Two monoclonal rat antibodies with specificity for the B-chain variable region VB6 of the murine T-cell receptor" Proc. Natl. Acad. Sc I, vol. 85, pp. 7695-7698, (1988)".
"Pilch, et al., "Improved Assessment of T-Cell Receptor (TCR) VB Repertoire in clinical Specimens: Combination of TCR-CDR3 Spectratyping with Flow Cytometry-Based TCR VB Frequency Analysis" (2002) Clinical and Diagnostic Laboratory Immunology, p. 257-266".
"Rath, et al., Engineering Streategies to Enhance TCR-Based Adoptive T Cell Therapy (2020) Cells, 9, 1485, p. 1-34".
"Ruggiero, et al., "High-resolution analysis of the human T-cell receptor repertoire" Nature Communication (2014) p. 1-7".
"Tang, et al., "Anti-TCR Antibody Treatment Activates a Novel Population of Nonintestinal CD8aa+TCRaB+ Regulatory T Cells and Prevents Experimental Autoimmune Encephalomyelitis" The Journal of Immunology (2017) p. 1-9".
"Vannucchi, et al., "Calreticulin mutation-specific immunostaining in myeloproliferative neoplasms: pathogenetic insight and diagnostic value" Leukemia (2014) 28, p. 1811-1818".
"Vonderheid, et al., "Evidence for Restricted VB Usage in the Leukemic Phase of Cutaneous T Cell Lymphoma" (2015) The Society for Investigative Dermatology, Inc. p. 650-661".
"Vyas, et al., "Natural ligands and antibody-based fusion proteins: harnessing the immune system against cancer" Cell (2013) p. 1-11".
"Wu, et al., "B7H6-specific bispecific T cells engagers (BiTEs) lead to tumor elimination and host anti-tumor immunity 1,2" J Immunolo. (2015) 194(11), p. 5305-5311".
"Zhang, et al., "Cancer Immunotherapy Using a Bispecific NK Receptor fusion Protein that Engages both T Cells and Tumor cells" Cancer Research (2011) 71(6) p. 2066-2077".
Adachi, O. et al., "Targeted Disruption of the MyD88 Gene Results in Loss of IL-1-and IL-8-Mediated Function", Immunity, 1998, vol. 9, pp. 143-150.
Agostinis, P. et al., "Photodynamic Therapy of Cancer: An Update", CA Cancer J. Clin, 2011, vol. 61, No. 4, pp. 250-281.
Ala-Aho, R. et al., "Collagenases in cancer", Biochimie, 2005, vol. 87, pp. 273-286.
Al-Aghbar, M.A. et al., "High-affinity ligands can trigger T cell receptor signaling without CD45 segregation," Frontiers in Immunology, 2018;9(713):1-18.
Al-Lazikani, B. et al., "Standard Conformations for Canonical Structures of Immunoglobulins", J. Mol. Biol., 1997, vol. 273 ,pp. 927-948.
Altschul, S. et al., "Basic Local Alignment Search Tool", J. Mol Biol., 1990, vol. 215, pp. 403-410.
Altschul, S. et al., "Gapped BLAST and PSI-BLAST: a new generation of protein database search programs", Nucleic Acids Research, 1997, vol. 25, No. 17, pp. 3389-3402.
Arai, R. et al., "Design of the linkers which effectively separate domains of a bifunctional fusion protein", Protein Engineering, 2001, vol. 14, No. 8, pp. 529-532.
Arnon, T.I. et al., "Recognition of viral hemagglutinins by NKp44 but not by NKp30", Eur J. Immunol., 2001, vol. 31, No. 9, pp. 2680-2689.
Barbas, C.F. et al., "Assembly of combinatorial antibody libraries on phage surfaces: The gene III site", PNAS, 1991, vol. 88, pp. 7978-7982.
Beidler,C.B. et al., "Cloning and high level expression of a chimeric antibody with specificity for human carcinoembryonic antigen", J. Immuno, 1988, vol. 141, pp. 4053-4060.
Berge, et al., "Selective expansion of a peripheral blood CD8+ memory T cell subset expressing both granzyme B and I-selectin during primary viral infection in renal allograft recipients", Transplantation Proceedings, 1998, vol. 30, pp. 3975-3977.
Better, M. et al., "*Escherichia coli* Secretion of an Active Chimeric Antibody Fragment", Science, 1988, vol. 240, No. 4855, pp. 1041-1043.
Beun, G. et al., "T cell Retargeting Using Bispecific Monoclonal Antibodies in a Rat Colon Carcinoma Model", The Journal of Immunology, 1993, vol. 150, No. 6, pp. 2305-2315.
Bird, R. et al., "Single-Chain Antigen-Binding Proteins", Science, 1988, vol. 242, No. 4877, pp. 423-426.
Bolt, S et al., "The generation of a humanized, non-mitogenic CD3 monoclonal antibody which retains in vitro immunosuppressive properties," Eur. J. Immunol., 1993;23:403-411.
Breman, E. et al., "Overcoming target driven fratricide for T Cell Therapy," Frontiers in Immunology, 2018;9(2940):1-11.

(56) References Cited

OTHER PUBLICATIONS

Bruggemann, M. et al., Designer Mice: The Production of Human Antibody Repertories in Transgenic Animals, Terhorst C. Malavasi F, Albertini A (eds): Generation of Antibodies by Cell and Gene Immortalization, Year Immunol, 1993, vol. 7, pp. 33-40.
Bruggemann, M. et al., "Human antibody production in transgenic mice: expression from 100kb of the human IgH locus", Eur J. Immunol, 1991, vol. 21, pp. 1323-1326.
Cain, C. et al., "Crossing over to bispecificity", SciBX, 2011, vol. 4, pp. 1-3.
Chao, G. et al., "Isolating and engineering human antibodies using yeast surface display", Nature Protocols, 2006, vol. 1, No. 2, pp. 755-768.
Chiang, E. et al., "Abstract 3527: Potent anti-tumor activity of AbGn-100, an anti-CD326 x anti-TCR bispecific antibody to CD326-expressing solid tumors," Cancer Res., 2012;72(8_supplement):3527.
Chichili, V.P.R. et al., "Linkers in the structural biology of protein-protein interactions," Protein Science, 2013;22:153-167.
Schmittnaegel, M. et al., "Activation of cytomegalovirus-specific CD8+ T-cell response by antibody-mediated peptide-major histocompatibility class I complexes", OncoImmunology, 2015, vol. 5, No. 1, pp. 1-3.
Chothia, C. et al., "Canonical Structures for the Hypervariable Regions of Immunoglobulins", J. Mol. Biol, 1987, vol. 196, pp. 901-917.
Chothia et al., Structural repertoire of the human VH segments. J Mol Biol 227:799-817 (1992).
Ciccone, E. et al., "A monoclonal antibody specific for a common determinant of the human T cell receptor gamma/delta directly activates CD3+WT31-lymphocytes to express their functional program(s)," J Exp Med., 1988;168(1):1-11.
Clackson, T. et al., Making antibody fragments using phage display libraries, Nature, 1991, vol. 352, pp. 624-628.
Colcher, D. et al., "Single-Chain Antibodies in Pancreatic Cancer", Ann Ny Acad Sci, 1999, vol. 880, pp. 263-280.
Coloma, J. et al., "Design and production of novel tetravalent bispecific antibodies", Nature Biotech, 1997, vol. 15, pp. 159-163.
Costa-Mattioli, M. et al., "RAPping production of type I interferon in pDCs through mTOR", 2008, Nature Immunol, vol. 9, No. 10, pp. 1097-1099.
Davis, J. et al., "SEEDbodies: fusion proteins based on strand-exchange engineered domain (SEED) CH3 heterodimers in an Fc analogue platform for asymmetric binders or immunofusions and bispecific antibodies", Protein Engineering, Design & Selection, 2010, vol. 23, No. 4, pp. 195-202.
Doyle, S. et al., "IRF3 Mediates a TLR3/TLR4-Specific Antiviral Gene Program", Immunity, 2002, vol. 17, pp. 251-263.
El Achi, H. et al., "CD123 as a Biomarker in Hematolymphoid Malignancies: Principles of Detection and Targeted Therapies," Cancers, 2020;12(11):3087.
European Patent Application No. 19745444.0 communication pursuant to Article 94(3) EPC dated Jan. 28, 2022.
Frost, G. et al., "A Microtiter-Based Assay for Hyaluronidase Activity Not Requiring Specialized Reagents", Analytical Biochemistry, 1997, vol. 251, pp. 263-269.
Fuchs, P. et al., "Targeting Recombinant Antibodies to the surface of *Escherichia Coli*: Fusion to the Peptidoglycan associated Lipoprotein", Nature Publishing Group, 1991, vol. 9, No. 12, pp. 1369-1372.
Garland, R.J., et al., "The use of Teflon cell culture bags to expand functionally active CD8+ cytotoxic T lymphocytes", Journal of Immunological Methods, 1999, vol. 227, pp. 53-63.
Garrard, L. et al., "FAB Assembly and Enrichment in a Monovalent Phage Display System", Nature Publishing Group, 1991, vol. 9, pp. 1373-1377.
Garrity, D. et al., "The activating NKG2D receptor assembles in the membrane with two signaling dimers into a hexameric structure", Proc Natl Acad Sci USA, 2005, vol. 102, No. 21, pp. 7641-7646.

Gillies, S.D. et al., "Bi-functional cytokine fusion proteins for gene therapy and antibody-targeted treatment of cancer," Cancer Immunol Immunotherapy, 2002;51:449-460.
Goel, M. et a., "Plasticity within the Antigen-Combining site may manifest as molecular mimicry in the humoral immune response," J Immunology, 2004;173(12):7358-7367.
Gohal, G. et al., "T-cell receptor phenotype pattern in atopic children using commercial fluorescently labeled antibodies against 21 human class-specific v segments for the tcrβ chain (vβ) of peripheral blood: a cross sectional study," Allergy Asthma Clin Immunol., 2016;12:10.
Gordon, E.D. et al., "Alternative splicing of interleukin-33 and type 2 inflammation in asthma," PNAS, 2016;113(31):8765-8770.
Gram, H. et al., In vitro selection and affinity maturation of antibodies from a naïve combinatorial immunoglobulin library, PNAS, 1992, vol. 89, pp. 3576-3580.
Green, L.L. et al., "Antigen-specific human monoclonal antibodies from mice engineered with human Ig heavy and light chain YACS", Nature Genet, 1994, vol. 7, pp. 13-21.
Griffiths, A.D. et al., "Human anti-self antibodies with high specificity from phage display libraries", The EMBO Journal, 1993, vol. 12, No. 2, pp. 725-734.
Gulley, J.L. et al., "New drugs on the horizon," Eur J Cancer, 2022;174(S1):S5.
Gupta, S. et al., "T cell activation via the T cell receptor: a comparison between WT31 (defining alpha/beta TcR)-induced and anti-CD3-induced activation of human T lymphocytes," Cell Immunol., 1991;132(1):26-44.
Haanen, J. et al., "Selective Expansion of Cross-reactive CD8+ Memory T Cells by Viral Variants", J. Exp. Med., 1999, vol. 190, No. 9, pp. 1319-1328.
Halin, C. et al., "Synergistic Therapeutic Effects of a Tumor Targeting Antibody Fragment, Fused to Interleukin 12 and to Tumor Necrosis Factor a1," Cancer Research, 2003;63:3202-3210.
Hall, M. et al., "Expansion of tumor-infiltrating lymphocytes (TIL)from human pancreatic tumors", Journal for ImmunoTherapy of Cancer, 2016, vol. 4, pp. 1-12.
Hamid, O. et al., "Safety and Tumor Responses with Lambrolizumab (Anti-PD-1) in Melanoma", The New England Journal of Medicine, 2013, vol. 369, No. 2, pp. 134-144.
Hawkins, R. et al., "Selection of phage antibodies by binding affinity. Mimicking affinity maturation", J. Mol. Biol., 1992, vol. 226, No. 3, pp. 889-896.
Hay, B. et al., "Bacteriophage cloning and Escherichia coli expression of a human IgM Fab" Hum Antibodies Hybridomas, 1992, vol. 3, No. 2, pp. 81-85.
Shimabukuro-Vornhagen, A. et al., "Cytokine release syndrome", Journal for ImmunoTherapy of Cancer, 2018, vol. 6, No. 56, pp. 1-14.
Hiyama, K. et al., "Crystallization and Some Properties of Chondroitinase from Arthrobacter aurescens", The Journal of Biological Chemistry, 1975, vol. 250, No. 5, pp. 1824-1828.
Hiyama, K. et al., "The mode of Action of Two Chondroitinase-AC Preparations of Different Origin", J. Biochem, 1976, vol. 80, pp. 1201-1207.
Hombach, A.A. et al., "Antibody-IL2 Fusion Proteins for Tumor Targeting," Antibody Engineering, 2012:611-626.
Hoogenboom, H.R. et al., "Multi-subunit proteins on the surface of filamentous phage: methodologies for displaying antibody (Fab) heavy and light chains", Nuc Acid Res, 1991, vol. 19, No. 15, pp. 4133-4137.
Hunig, T. et al., "A monoclonal antibody to a constant determinant of the rat t cell antigen receptor that induces t cell activation", J. Exp. Med., 1989, vol. 169, pp. 73-86.
Huse, W. et al., "Generation of a large combinatorial library of the immunoglobulin repertoire in phage lambda" Science, 1989, vol. 246, No. 4935, pp. 1275-1281.
Huston, J. et al., "Protein engineering of antibody binding sites: Recovery of specific activity in an anti-digoxin single-chain Fv analogue produces in *Escherichia coli*", Proc Natl Acad Sci, 1988, vol. 85, pp. 5879-5883.
International Preliminary Report on Patentability issued in PCT/US2019/040592, dated Jan. 5, 2021.

(56) References Cited

OTHER PUBLICATIONS

International Search Report and Written Opinion issued in PCT/US2019/040592, dated Jan. 9, 2020.
Jameson, Stephen C., "T cell receptor antagonism in vivo, at last", Proc. Natl. Acad. Sci., 1998, vol. 95, pp. 14001-14002.
Jiang, B. et al., "A novel peptide isolated from a phage display peptide library with trastuzumab can mimic antigen epitope of HER-2*," The Journal of Biological Chemistry, 2005;280(6):4656-4662.
Jones, P. T. et al., "Replacing the complementarity-determining regions in a human antibody with those from a mouse", Nature, 1986, vol. 321, No. 29, pp. 522-525.
Kerkela, E. et al., "Expression of Human Macrophage Metalloelastase (MMP-12) by Tumor Cells in Skin Cancer", Journal of Investigative Dermatology, 2000, vol. 114, No. 6, pp. 1113-1119.
Kiefer, J.D. et al., "Immunocytokines and bispecific antibodies: two complementary strategies for the selective activation of immune cells at the tumor site," Immunol Rev., 2016;270(1):178-192.
Kim, E.J. et al., "Interleukin-2 fusion protein with anti-CD3 single-chain Fv (sFv) selectively protects T cells from dexamethasone-induced apoptosis," Vaccine, 2002;20:608-615.
Klein, C. et al., "Progress in overcoming the chain association issue in bispecific heterodimeric IgG antibodies", mAbs, 2012, vol. 4, No. 6, pp. 653-663.
Labrijn, A. et al., "Controlled Fab-arm exchange for the generation of stable bispecific IgG1", Nature Protocols, 2014, vol. 9, No. 10, pp. 2450-2463.
Labrijn, A. et al., "Efficient generation of stable bispecific IgG1 by controlled Fab-arm exchange", PNAS, 2013, vol. 113, No. 13, pp. 5145-5150.
Lanier, L.L. et al., "Distinct epitopes on the t cell antigen receptor of HPB-ALL tumor cells identified by monoclonal antibodies," 1986;137(7):2286-2292.
Leclercq, G. et al., "Dissecting the mechanism of cytokine release induced by T-cell engagers highlights the contribution of neutrophils," Oncoimmunology, 2022;11(1):e2039432.
Lee, K.D. et al., "Construction and characterization of a novel fusion protein consisting of anti-CD3 antibody fused to recombinant interleukin-2," Oncology Reports, 2006;15:1211-1216.
Leonard, E.K. et al., "Engineered cytokine/antibody fusion proteins improve delivery of IL-2 to pro-inflammatory cells and promote antitumor activity," bioRxiv, 2023:1-36.
Li, F. et al., "T cell receptor B-chain-targeting chimeric antigen receptor T cells against T cell malignancies," Nature Communications, 2022;13:4334.
Li, H. et al., "Tumor Microenvironment: The Role of the Tumor Stroma in Cancer", Journal of Cellular Biochemistry, 2007, vol. 101, pp. 805-815.
Li P. et al., "Design and synthesis of paclitaxel conjugated with an ErbB2-recognizing peptide," EC-1, 2007, Biopolymers, vol. 87, No. 4, pp. 225-230.
Liu, A. et al., "Production of a mouse-human chimeric monoclonal antibody to CD20 with potent Fc-dependent biologic activity", J Immunol, 1987, vol. 139, No. 10, pp. 3521-3526.
Liu, A.Y. et al., "Chimeric mouse-human IgG1 antibody that can mediate lysis of cancer cells", PNAS, 1987, vol. 84, pp. 3439-3443.
Liu, D.V. et al., "Engineered Interleukin-2 Antagonists for the Inhibition of Regulatory T Cells," J. Immunother., 2009;32(9):887-894.
Liu, D.Z. et al., "Synthesis of 2'-paclitaxel 2-glucopyranosyl succinate for specific targeted delivery to cancer cells", Bioorganic & Medicinal Chemistry Letters, 2007, vol. 17, pp. 617-620.
Liu, K. et al., "CD123 and its potential clinical application in leukemias," Life Sciences, 2015;122:59-64.
Lobuglio, A. et al., "Phase I Clinical Trial of CO17-1A Monoclonal Antibody", Hybridoma, 1986, vol. 5, No. 1, pp. S117-S123.
Lonberg, N. et al., "Antigen-specific human antibodies from mice comprising four distinct genetic modifications", Nature, 1994, vol. 368, pp. 856-859.
Lustgarten, J. et al., "Redirecting Effector T Cells through their IL-2 receptors," J Immunology, 1999;162:359-365.
MacKay, C.R. et al., "Gamma/delta T cells express a unique surface molecule appearing late during thymic development," Eur J Immunol., 1989;19(8):1477-1483.
Mandelboim, O. et al., "Recognition of hemagglutinins on virus-infected cells by NKp46 activates lysis by human NK cells", Nature, 2001, vol. 409, No. 6823, pp. 1055-1060.
Martens, T. et al., "A Novel One-Armed Anti-c-Met Antibody Inhibits Glioblastoma Growth In vivo", Clin Cancer Res, 2006, vol. 12, No. 20, pp. 6144-6152.
Martin, A. et al., "Chapter 3: Protein Sequence and Structure Analysis of Antibody Variable Domains", In: Antibody Engineering Lab Manual (Ed: Duebel, S. and Kontermann, R., Springer-Verlag, Heidelberg), 2010, vol. 2, pp. 33-51.
Martin, F. et al., "The affinity-selection of a minibody polypeptide inhibitor of human interleukin-6", EMBO J., 1994, vol. 13, No. 22, pp. 5303-5309.
McConnell, S.J. et al., "Tendamistat as a scaffold for conformationally constrained phage peptide libraries", J Mol Biol, 1995, vol. 250, No. 4, pp. 460-470.
Merchant, A.M. et al., "An efficient route to human bispecific IgG," Nature Biotechnology, 1998;16(7):677-681.
Meyers, E. et al., "Optimal alignments in linear space", CABIOS, 1988, vol. 4, No. 1, pp. 11-17.
Michelacci, Y. et al., "A Comparative Study Between a Chondroitinase B and a Chondroitinase AC from Flavobacterium heparinum", Biochem J., 1975, vol. 151, pp. 121-129.
Michelacci, Y. et al., "Isolation and Partial Characterization of an Induced Chondroitinase B from Flavobacterium Heparinum", Biochemical and Biophysical Research Communications, 1974, vol. 56, No. 4, pp. 973-980.
Mitra, S. et al., "Interleukin-2 Activity can be Fine-Tuned with Engineering Receptor Signaling Clamps," Immunity, 2015;42(5):826-838.
Moore, G. et al., "A novel bispecific antibody format enables simultaneous bivalent and monovalent co-engagement of distinct target antigens", mAbs, 2011, vol. 3, No. 6, pp. 546-557.
Morrison, Sherie L., "Transfectomas provide novel chimeric antibodies", Science, 1985, vol. 229, No. 4719, pp. 1202-1207.
Morrison, S.L. et al., "Chimeric human antibody molecules: Mouse antigen-binding domains with human constant region domains", Proc Natl Acad Sci, 1984, vol. 81, pp. 6851-6855.
Needleman, S. et al., "A General Method Applicable to the Search for Similarities in the Amino Acid Sequence of Two Proteins", J. Mol. Biol., 1970, vol. 48, pp. 444-453.
Niederberger, N. et al., "Thymocyte stimulation by anti-TCR-b, but not by anti-TCR-a, leads to induction of developmental transcription program," Journal of Leukocyte Biology, 2005;77(5):830-841.
Nishimura, Y. et al., "Recombinant Human-Mouse Chimeric Monoclonal Antibody Specific for Common Acute Lymphocytic Leukemia Antigen", Canc. Res, 1987, vol. 47, pp. 999-1005.
Oi, V. et al., "Chimeric Antibodies", BioTechniques, 1986, vol. 4, No. 3, pp. 214-221.
Park, Y.P. et al., "Complex Regulation of human NKG2D-DAP10 cell surface expression: opposing roles of the γc cytokines and TGF-β1", Blood, 2011, vol. 118, No. 11, pp. 3019-3027.
Pasche, N. et al., "Immunocytokines: a novel class of potent armed antibodies," Drug Discovery Today, 2012;17(11):583-590.
Posnett, D.N. et al., "Inherited polymorphism of the human T-cell antigen receptor detected by a monoclonal antibody," PNAS, 1986;83:7888-7892.
Qi, et al., "Potent and selective antitumor activity of a T cell-engaging bispecific antibody targeting a membrane-proximal epitope of ROR1," PNAS, 2018;115(24):E5467-E5476.
Rabia, L. et al., "Understanding and overcoming trade-offs between antibody affinity, specificity, stability and solubility," Biochemical Engineering Journal, 2018;137:365-374.
Rakoff-Nahoum, S. et al., "Toll-like receptors and cancer", Nat Revs Cancer, 2009, vol. 9, pp. 57-63.

(56) References Cited

OTHER PUBLICATIONS

Reiter, Y et al., "Antibody Engineering of Recombinant Fv Immunotoxins for Improved Targeting of Cancer: Disulfide-stabilized Fv Immunotoxins", Clin Cancer Res, 1996, vol. 2, pp. 245-252.
Ridgway, J. et al., Knobs-into holes engineering of antibody CH3 domains for heavy chain heterodimerization, Protein Engineering, 1996, vol. 9, No. 7. pp. 617-621.
Riemer, A.B. et al., "Matching of trastuzumab (Herceptin) epitope mimics onto the surface of Her-2/neu—a new method of epitope definition," Molecular Immunology, 2005;42:1121-1124.
Rosenberg, S. et al., "Use of Tumor-Infiltrating Lymphocytes and Interleukin-2 in the Immunotherapy of Patients with Metastatic Melanoma", New Eng J of Med, 1988, vol. 319, pp. 1676-1680.
Rudikoff, S. et al., "Single amino acid substitution altering antigen-binding specificity", Proc. Natl. Acad. Sci., 1982, vol. 19, pp. 1979-1983.
Saleh, M.N. et al., "A phase II trial of murine monoclonal antibody 17-1A and interferon-γ: clinical and immunological data", Cancer Immunol Immunother, 1990, vol. 32, pp. 185-190.
Sano, Y. et al., "Properties of Blocking and Non-blocking Monoclonal Antibodies Specific for Human Macrophage Galactose-type C-type Lectin (MGL/ClecSF10A/CD301)," J. Biochem., 2007;127-136.
Scodeller, Pablo, "Hyaluronidase and other Extracellular Matrix Degrading Enzymes for Cancer Therapy: New Uses and Nano-Formulations", Journal of Carcinogenesis & Mutagenesis, 2014, vol. 5, No. 4, pp. 1-5.
Seidel, U. et al., "Natural killer cell mediated antibody-dependent cellular cytotoxicity in tumor immunotherapy with therapeutic antibodies", frontiers in Immunology, 2013, vol. 4, No. 76, pp. 1-8.
Sekine, T. et al., "A feasible method for expansion of peripheral blood lymphocytes by culture with immobilized anti-CD3 monoclonal antibody and interleukin-2 for use in adoptive immunotherapy of cancer patients," Biomed & Pharmacother, 1993;47:73-78.
Sen, S. et al., "Expression of epithelial cell adhesion molecule (EpCAM) in oral squamous cell carcinoma," Histopathology, 2015:6:897-904. Abstract only.
Shaw, D. et al., "Mouse/human chimeric antibodies to a tumor-associated antigen: biologic activity of the four human IgG subclasses", Journal of the National Cancer Institute, 1988, vol. 80, No. 19. pp. 1553-1559.
Shi, M. et al., "A recombinant anti-erbB2, scFv-Fc-IL-2 fusion protein retains antigen specificity and cytokine function," Biotechnology letters, 2003;25:815-819.
Spiess, C. et al., "Alternative molecular formats and therapeutic applications for bispecific antibodies", Molecular Immunology, 2015, vol. 67, pp. 95-106.
Stauber, D.J. et al., "Crystal structure of the IL-2 signaling complex: Paradigm for a heterotrimeric cytokine receptor," PNAS, 2006;103(8):2788-2793.
Sun, L.K. et al., "Chimeric antibody with human constant regions and mouse variable regions directed against carcinoma-associated antigen 17-1A", PNAS, 1987, vol. 84, pp. 214-218.
Thorpe, P. E., "Vascular Targeting Agents as Cancer Therapeutics", Clinc Cancer Res, 2004, vol. 10, pp. 415-427.
Tomlinson, I. et al., "The repertoire of human germline vH sequences reveals about fifty groups of VH segments with different hypervariable loops", Journal of Molecular Biology, 1992, vol. 227, No. 3, pp. 776-798.
Tomonari, K. et al., "Epitope-specific binding of CD8 regulates activation of T cells and induction of cytotoxicity," International Immunology, 1990;2(12):1189-1194.
Tramontano, A. et al., "The making of the minibody: An engineered β-protein for the display of conformationally constrained peptides", Journal of Molecular Recognition, 1994, vol. 7, pp. 9-24.
Tsytsikov, V.N. et al., "Identification and Characterization of Two Alternative Splice Variants of Human Interleukin-2*" The Journal of Biological Chemistry, 1996;71(38):23055-23060.
Tuaillon, N. et al., Human immunoglobulin heavy-chain minilocus recombination in transgenic mice: Gene-segment use in μ and γ transcripts, PNAS, 1993, vol. 90, pp. 3720-3724.
U.S. Appl. No. 17/529,017 Non-Final Office Action dated Apr. 27, 2022.
Suzuki, S. et al., "Formation of Three Types of Disulfated Disaccharides from Chondroitin Sulfates by Chondroitinase Digestion", The Journal of Biological Chemistry, 1968, vol. 243, No. 7, pp. 1543-1550.
Verhoeyen, M. et al., "Reshaping Human Antibodies: Grafting an Antilysozyme Activity", Science, 1988, vol. 239, pp. 1534-1536.
Verwilghen, J. et al., "Differences in the stimulating capacity of immobilized anti-CD3 monoclonal antibodies: variable dependence on interleukin-1 as a helper signal for T-cell activation," 1991;72:269-276.
Wadia, P. et al., "Impaired lymphocyte responses and their restoration in oral cancer patients expressing distinct TCR variable region," Cancer Investigation, 2008;26:471-480.
Wan, Y.Y. et al., "Yin-Yang' functions of TGF-b and tregs in immune regulation," Immunol Rev., 2007;220:199-213.
Wang, C.Y. et al., "αβ T-cell receptor bias in disease and therapy (Review)", International Journal of Oncology, 2016, vol. 48, pp. 2247-2256.
Wei, S. et al., "Identification of a novel human T-cell receptor VB subfamily by genomic cloning", Human Immunology, 1994, vol. 41, No. 3, pp. 201-206.
Weidle, U. et al., "The Intriguing Options of Mulitspecific Antibody Formats for Treatment of Cancer", Cancer Genomics & Proteomics, 2013, vol. 1, pp. 1-18.
Wood, C. R. et al., "The synthesis and in vivo assembly of functional antibodies in yeast", Nature Publishing Group, 1985, vol. 314, No. 4, pp. 446-449.
Yamagata, T. et al., "Purification and Properties of Bacterial Chondroitinases and Chondrosulfatases", The Journal of Biological Chemistry, 1968, vol. 243, No. 7, pp. 1523-1535.
Yassai, M. et al., "A clonotype nomenclature for T cell receptors", Immunogenetics, 2009, vol. 61, pp. 493-502.
Yoon, S.T. et al., "Both high and low avidity antibodies to the T cell receptor can have agonist or antagonist activity," Immunity, 1994;1(7):563-569.
Lloyd, C. et al., "Modelling the human immune response: performance of a 1011 human antibody repertoire against a broad panel of therapeutically relevant antigens," Protein Engineering, Design & Selection, 2009;22(3):159-168.
Anderson, P.M. et al., "Anti-CD3 + IL-2-Stimulated Murine Killer Cells," J. Immunol., 1989;142(4):1383-1394.
Müller, K.P. et al., "T cell receptor targeting to thymic cortical epithelial cells in vivo induces survival, activation and differentiation of immature thymocytes," Eur. J. Immunol., 1993;23(7):1661-1670.
Cho, B.K. et al., "Single-Chain Fv/Folate Conjugates Mediate Efficient Lysis of Folate-Receptor-Positive Tumor Cells," Bioconjugate Chem., 1997;8(3):338-346.

* cited by examiner

VH

|  | Framework 1 | CDR 1 |
|---|---|---|

```
              1  2  3  4  5  6  7  8  9 10 11 12 13 14 15 16 17 18 19 20 21 22 23 24 25 | 26 27 28 29 30 31 32 33 34 35 |
SEQ ID NO: 1  Q  V  Q  L  Q  Q  S  G  P  E  L  V  K  P  G  T  S  V  K  I  S  C  K  A  S | G  Y  S  F  T  T  Y  Y  I  H  |
SEQ ID NO: 9  Q  V  Q  L  V  Q  S  G  A  E  V  K  K  P  G  S  S  V  K  V  S  C  K  A  S | G  Y  S  F  T  T  Y  Y  I  H  |
```

|  | Framework 2 | CDR 2 |
|---|---|---|

```
              36 37 38 39 40 41 42 43 44 45 46 47 48 49 50 51 | 52 52a 53 54 55 56 57 58 59 60 61 62 63 64 65 |
SEQ ID NO: 1  W  V  K  Q  R  P  G  Q  G  L  E  W  I  G        | W   F   P  G  S  G  N  I  K  Y  N  E  K  F  K  G |
SEQ ID NO: 9  W  V  R  Q  A  P  G  Q  G  L  E  W  M  G        | W   F   P  G  S  G  N  I  K  Y  N  E  K  F  K  G |
```

```
              66 67 68 69 70 71 72 73 74 75 76 77 78 79 80 81 82 82a 82b 82c 83 84 85 86 87 88 89 90 91 92 93 94
SEQ ID NO: 1  K  A  T  L  T  A  D  T  S  S  S  T  A  Y  M  Q  L  S   S   L   T  S  E  E  S  A  V  Y  F  C  A  G
SEQ ID NO: 9  R  V  T  I  T  A  D  T  S  T  S  T  A  Y  M  E  L  S   S   L   R  S  E  D  T  A  V  Y  Y  C  A  G
```

|  | CDR 3 | Framework 4 |
|---|---|---|

```
              95 96 97 98 99 100 100a 100b 101 | 102 103 104 105 106 107 108 109 110 111 112 113
SEQ ID NO: 1  S  Y  Y  S  Y  D   V    L    D   | Y   W   G   H   G   T   T   L   T   V   S   S
SEQ ID NO: 9  S  Y  Y  S  Y  D   V    L    D   | Y   W   G   Q   G   T   T   V   T   V   S   S
```

Framework 1 | CDR 1

|  | 1 2 3 4 5 6 7 8 9 10 11 12 13 14 15 16 17 18 19 20 21 22 23 | 24 25 26 27 28 29 30 31 32 33 34 |
|---|---|---|
| SEQ ID NO: 2  | D I L M T Q S Q K F M S T L G D R V S V S C | K A S Q N V G I N V V |
| SEQ ID NO: 10 | D I Q M T Q S P S S L S A S V G D R V T I T C | K A S Q N V G I N V V |
| SEQ ID NO: 11 | D I Q M T Q S P S S L S A S V G D R V T I T C | K A S Q N V G I N V V |

Framework 2 | CDR 2

|  | 35 36 37 38 39 40 41 42 43 44 45 46 47 48 49 | 50 51 52 53 54 55 56 |
|---|---|---|
| SEQ ID NO: 2  | W H Q Q K P G Q S P K A L I Y | S S S H R Y S |
| SEQ ID NO: 10 | W H Q Q K P G K A P K A L I Y | S S S H R Y S |
| SEQ ID NO: 11 | W H Q Q K P G K V P K A L I Y | S S S H R Y S |

Framework 3

|  | 57 58 59 60 61 62 63 64 65 66 67 68 69 70 71 72 73 74 75 76 77 78 79 80 81 82 83 84 85 86 87 88 |
|---|---|
| SEQ ID NO: 2  | G V P D R F T G S G S G T D F T L T I N N V Q S E D L A E Y F C |
| SEQ ID NO: 10 | G V P S R F S G S G S G T E F T L T I S S L Q P E D F A T Y F C |
| SEQ ID NO: 11 | G V P S R F S G S G S G T D F T L T I S S L Q P E D V A T Y F C |

CDR 3 | Framework 4

|  | 89 90 91 92 93 94 95 96 97 | 98 99 100 101 102 103 104 105 106 107 |
|---|---|---|
| SEQ ID NO: 2  | Q Q F K S Y P L T | F G A G T K L E L K |
| SEQ ID NO: 10 | Q Q F K S Y P L T | F G Q G T K L E L K |
| SEQ ID NO: 11 | Q Q F K S Y P L T | F G Q G T K L E I K |

Framework 1 / CDR 1:

| SEQ ID NO | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|---|---|---|---|---|---|---|---|---|---|---|---|---|---|---|
| SEQ ID NO: 16 | E | N | V | L | T | Q | S | P | A | I | M | S | A | S | L | G | E | K | V | T | M | S | C | R | A | S | S | S | V | - | N | Y | I | Y |
| SEQ ID NO: 26 | D | N | N | L | T | Q | S | P | S | F | L | S | A | S | V | G | D | R | V | T | I | T | C | R | A | S | S | S | V | - | N | Y | I | Y |
| SEQ ID NO: 27 | D | N | Q | L | T | Q | S | P | S | S | L | S | A | S | V | G | D | R | V | T | I | T | C | R | A | S | S | S | V | - | N | Y | I | Y |
| SEQ ID NO: 28 | E | N | V | L | T | Q | P | P | S | A | T | L | S | V | S | P | G | E | R | A | T | L | S | C | R | A | S | S | S | V | - | N | Y | I | Y |
| SEQ ID NO: 29 | Q | N | V | L | T | Q | P | P | S | - | A | S | G | T | P | G | Q | R | V | T | I | S | C | R | A | S | S | S | V | - | N | Y | I | Y |
| SEQ ID NO: 30 | S | N | E | L | T | Q | P | P | S | - | V | S | V | S | P | G | Q | T | A | R | I | T | C | R | A | S | S | S | V | - | N | Y | I | Y |

Framework 2 / CDR 2:

| SEQ ID NO | 35 | 36 | 37 | 38 | 39 | 40 | 41 | 42 | 43 | 44 | 45 | 46 | 47 | 48 | 49 | 50 | 51 | 52 | 53 | 54 | 55 | 56 |
|---|---|---|---|---|---|---|---|---|---|---|---|---|---|---|---|---|---|---|---|---|---|---|
| SEQ ID NO: 16 | W | Y | Q | Q | K | S | D | A | S | P | K | L | W | I | Y | Y | T | S | N | L | A | P |
| SEQ ID NO: 26 | W | Y | Q | Q | K | P | G | K | A | P | K | L | L | I | Y | Y | T | S | N | L | A | P |
| SEQ ID NO: 27 | W | Y | Q | Q | K | P | G | K | A | P | K | L | L | I | Y | Y | T | S | N | L | A | P |
| SEQ ID NO: 28 | W | Y | Q | Q | K | P | G | Q | A | P | R | L | L | I | Y | Y | T | S | N | L | A | P |
| SEQ ID NO: 29 | W | Y | Q | Q | L | P | G | T | A | P | K | L | L | I | Y | Y | T | S | N | L | A | P |
| SEQ ID NO: 30 | W | Y | Q | Q | K | S | G | Q | A | P | V | L | V | I | Y | Y | T | S | N | L | A | P |

FIG. 2B

Framework 3

| SEQ ID NO | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |
|---|---|---|---|---|---|---|---|---|---|---|---|---|---|---|---|---|---|---|---|---|---|---|---|---|---|---|---|---|---|---|---|---|
| SEQ ID NO: 16 | G | V | P | T | R | F | S | G | S | G | S | G | N | E | Y | S | L | T | I | S | S | M | E | G | E | D | A | A | T | Y | Y | C |
| SEQ ID NO: 26 | G | V | P | S | R | F | S | G | S | G | S | G | N | E | Y | T | L | T | I | S | S | L | Q | P | E | D | F | A | T | Y | Y | C |
| SEQ ID NO: 27 | G | V | P | S | R | F | S | G | S | G | S | G | N | D | Y | T | L | T | I | S | S | L | Q | P | E | D | F | A | T | Y | Y | C |
| SEQ ID NO: 28 | G | I | P | A | R | F | S | G | S | G | S | G | N | E | Y | T | L | T | I | S | S | L | Q | S | E | D | F | A | V | Y | Y | C |
| SEQ ID NO: 29 | G | V | P | D | R | F | S | G | S | G | S | G | N | E | Y | S | L | A | I | S | G | L | R | S | E | D | E | A | D | Y | Y | C |
| SEQ ID NO: 30 | G | I | P | E | R | F | S | G | S | G | S̲G̲ | I̲ | N | M | Y | T | L | T | I | S | G | A | Q | V | E | D | E | A | D | Y | Y | C |

CDR 3 / Framework 4

| SEQ ID NO | 89 | 90 | 91 | 92 | 93 | 94 | 95 | 96 | 97 | 98 | 99 | 100 | 101 | 102 | 103 | 104 | 105 | 106 | 107 |
|---|---|---|---|---|---|---|---|---|---|---|---|---|---|---|---|---|---|---|---|
| SEQ ID NO: 16 | Q | Q | F | T | S | S | P | F | T | F | G | S | G | T | K | L | E | I | K |
| SEQ ID NO: 26 | Q | Q | F | T | S | S | P | F | T | F | G | Q | G | T | K | L | E | I | K |
| SEQ ID NO: 27 | Q | Q | F | T | S | S | P | F | T | F | G | Q | G | T | K | L | E | I | K |
| SEQ ID NO: 28 | Q | Q | F | T | S | S | P | F | T | F | G | Q | G | T | K | L | E | I | K |
| SEQ ID NO: 29 | Q | Q | F | T | S | S | P | F | T | F | G | T | G | T | K | V | T | V | L |
| SEQ ID NO: 30 | Q | Q | F | T | S | S | P | F | T | F | G | T | G | T | K | V | T | V | L |

FIG. 2B (Continued)

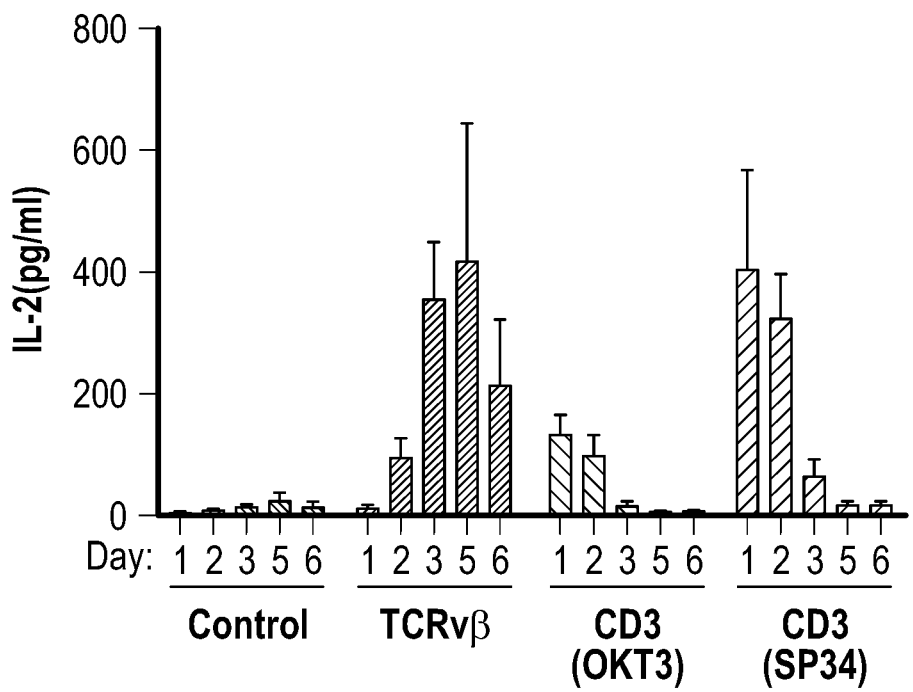
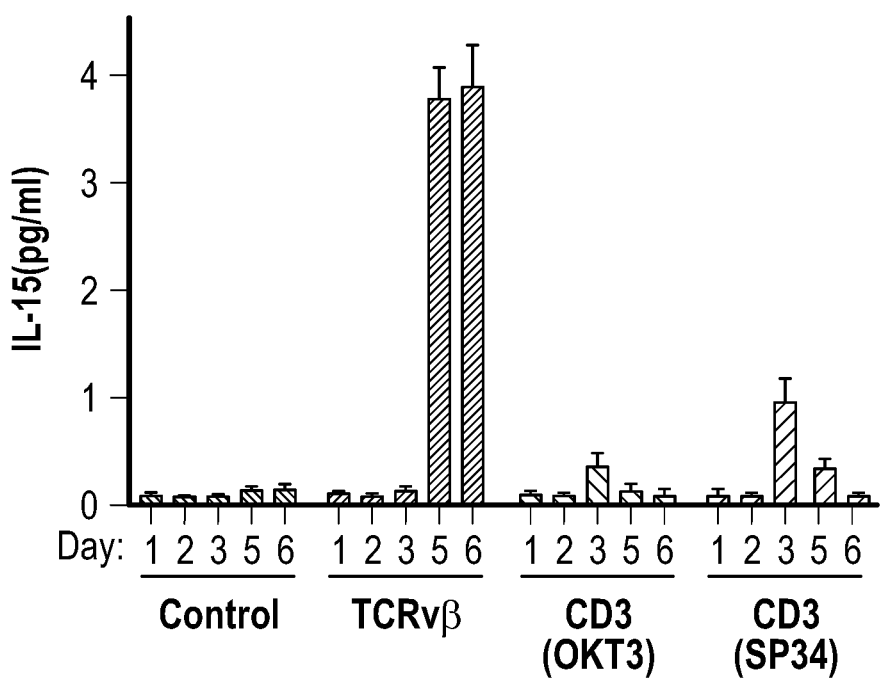
FIG. 14A

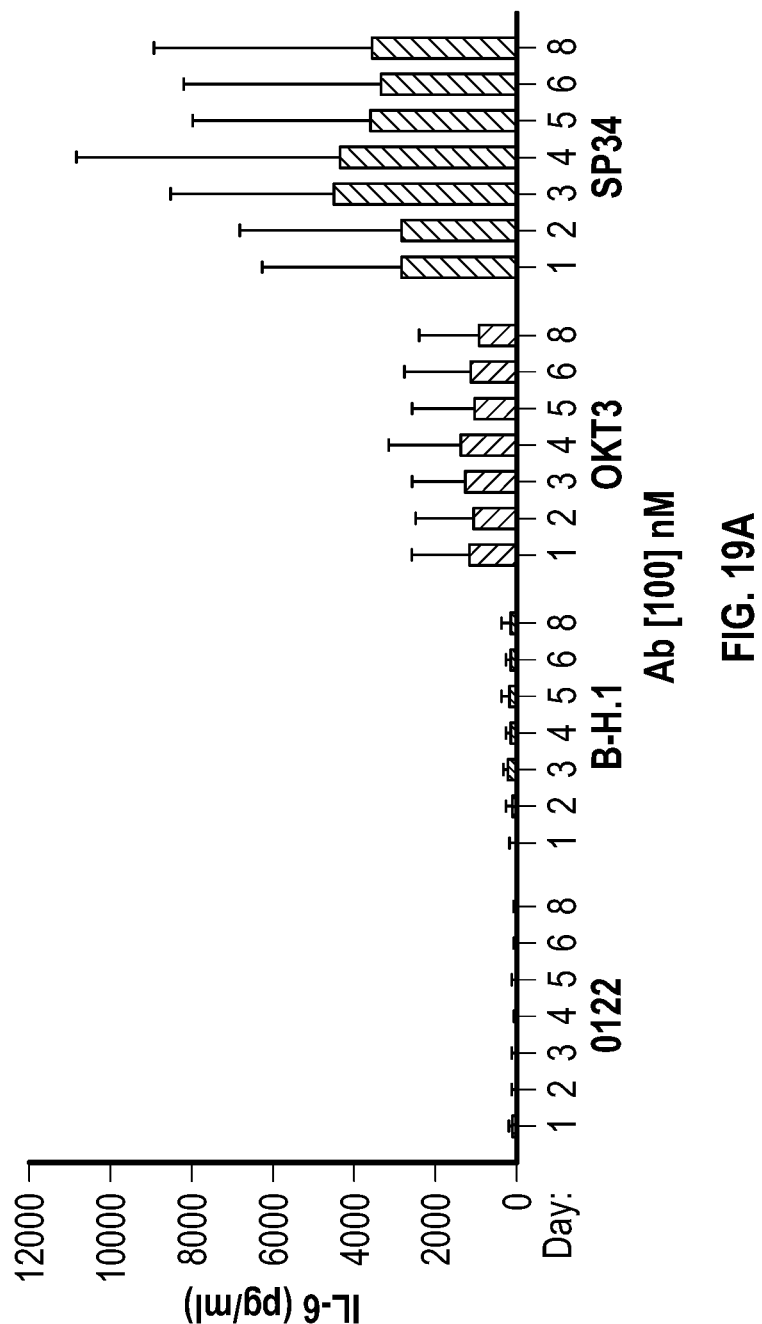

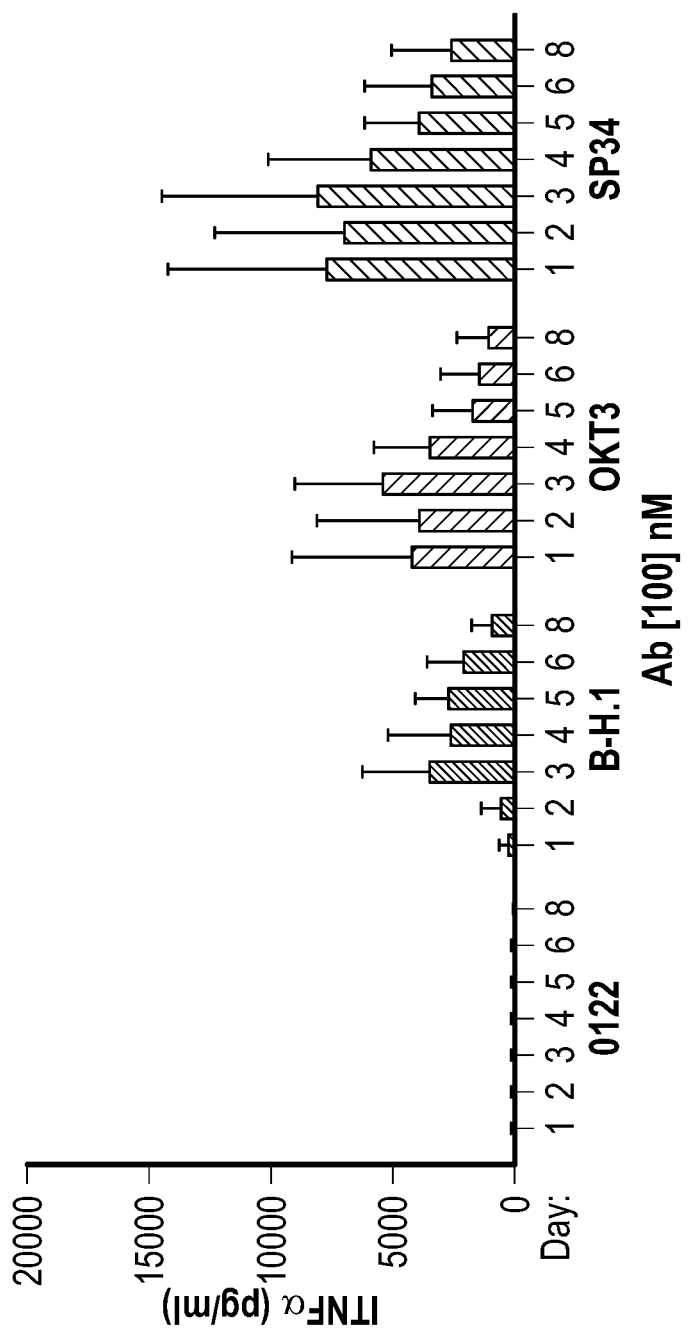

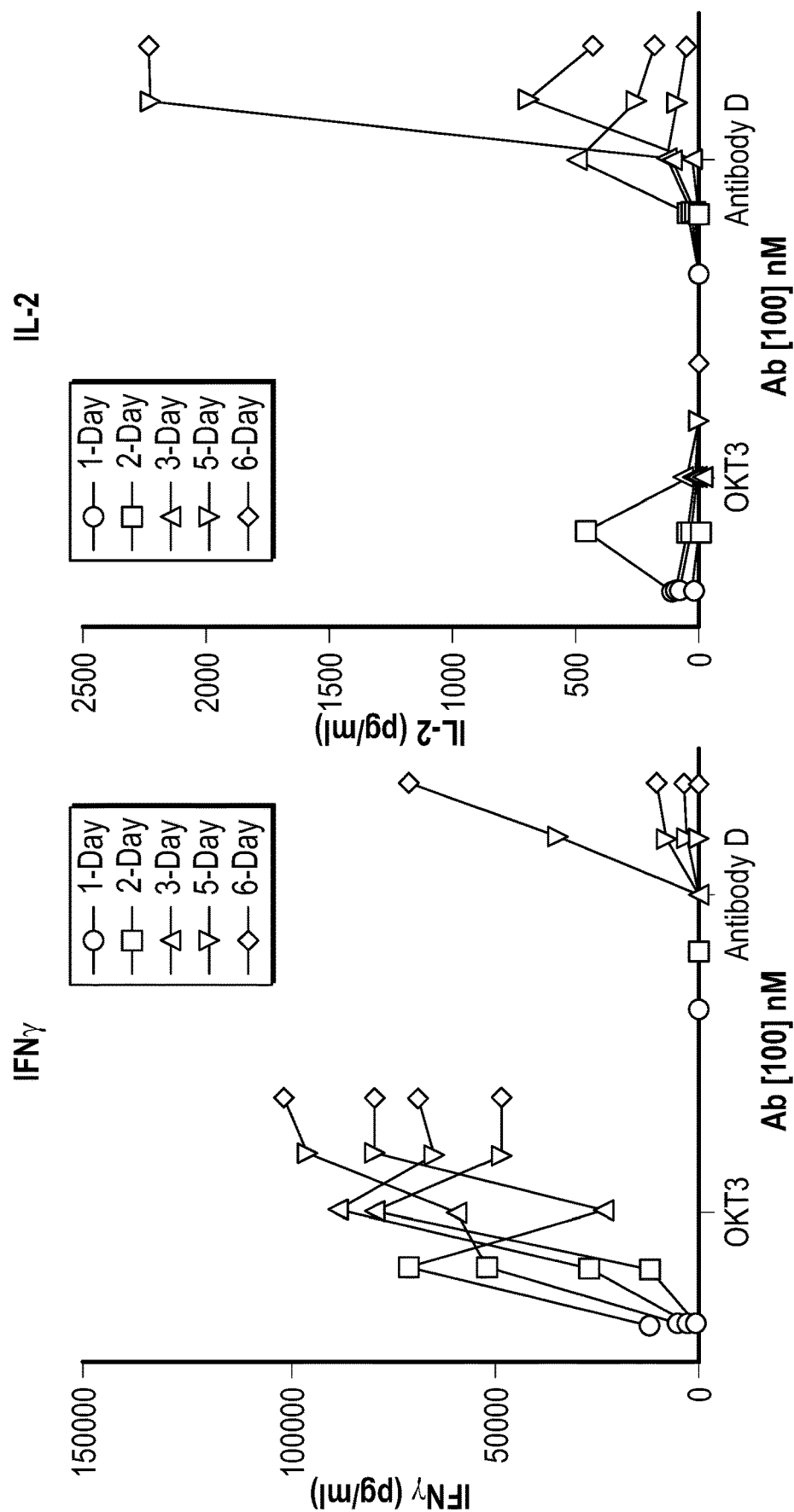

```
6DKP_Vb6_4  -IAGITQAPTSQILAAGRRMTLRCTQ-DMRHNAMYWYRQDLGLGLRLIHYSNTAGTTG---KGEVPDGYSVSRANTDDFPLTLASAVPSQTSVYFCASS-WSFGT--EA
2BNU_Vb6_5  ----GVTQTPKFQVLKTGQSMTLQCAQ-DMNHEYMSWYRQDPGMGLRLIHYSVGAGITD--QGEVPNGYNVSRSTTEDFPLRLLSAAPSQTSVYFCASS-YVGNTG-EL
4ZDH_Vb28   ---KVTQSSRYLVKRTGEKVFLECVQ-DMDHENMFWYRQDPGLGLRLIYFSYDVKME--KGDIPEGYSVSREKKERFSLIASASTDQTSMYLCASS-FLGTGV-EQ
5HHM_Vb19   --GGITQSPKYLFRKEGQNVTLSCEQ-NLNHDAMYWYRQDPGQGLRLIYYSQIVNDFQ--KGDIAEGYSVSREKKESFPLTVTSAQKNPTAFYLCASS--SRSSY-EQ
5KSA_Vb9    ---GVTQTPKHLITATGQRVTLRCSP-RSGDLSVIWYQQSLDQGLQFLIQYYNGEERA--KGNILERFSAQQFPDLHSELNLSSLELGDSALYFCASS-VAGTPSYEQ
5BS0_Vb5_1  --AGVTQTPRYLIKTRGQQVTLSCSP-ISGHRSVSWYQQTPGQGLQFLFEYFSETQRN--KGNFPGRFSGRQFSNSRSEMNVSTLELGDSALYLCASS-FNMATG--Q
3MFG_Vb20_1 --AVVSQHPSRVIVKSGTSVKIECRSLDFQATTMFWYRQFP--SLMLMATSNEGSKATYEQGVEKDKFLINHASLTLSTLVTSAHPEDSGFYICSA-----LAQDTQ
5COC_Vb12_4 MDAGVIQSPRHEVTEMGQQVTLRCKPIS-GHDYLFWYRQTMRGLELLIYFNNNVPID-DSGMPEDRFSAKMPNASFSTLKIQPSEPRDSAVFCASSLWEKLAKNIQ
```

FIG. 24B

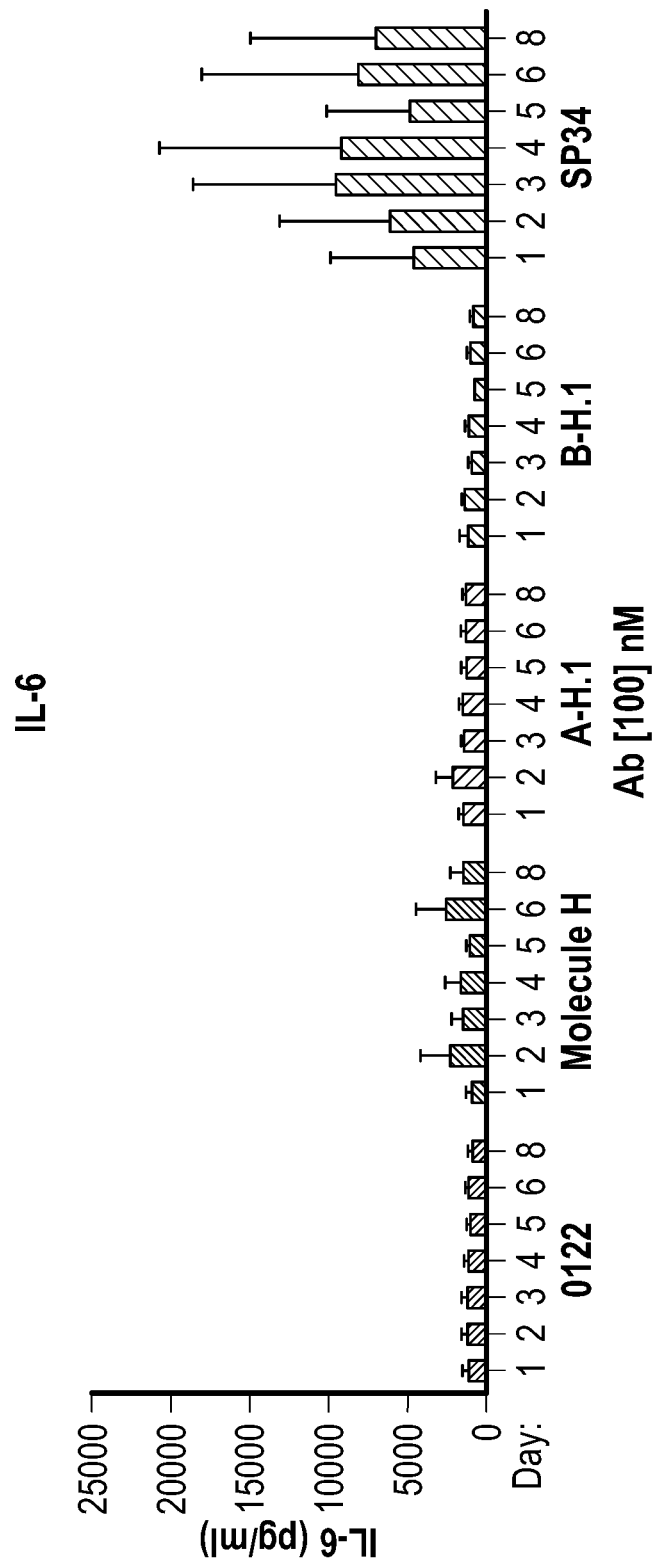

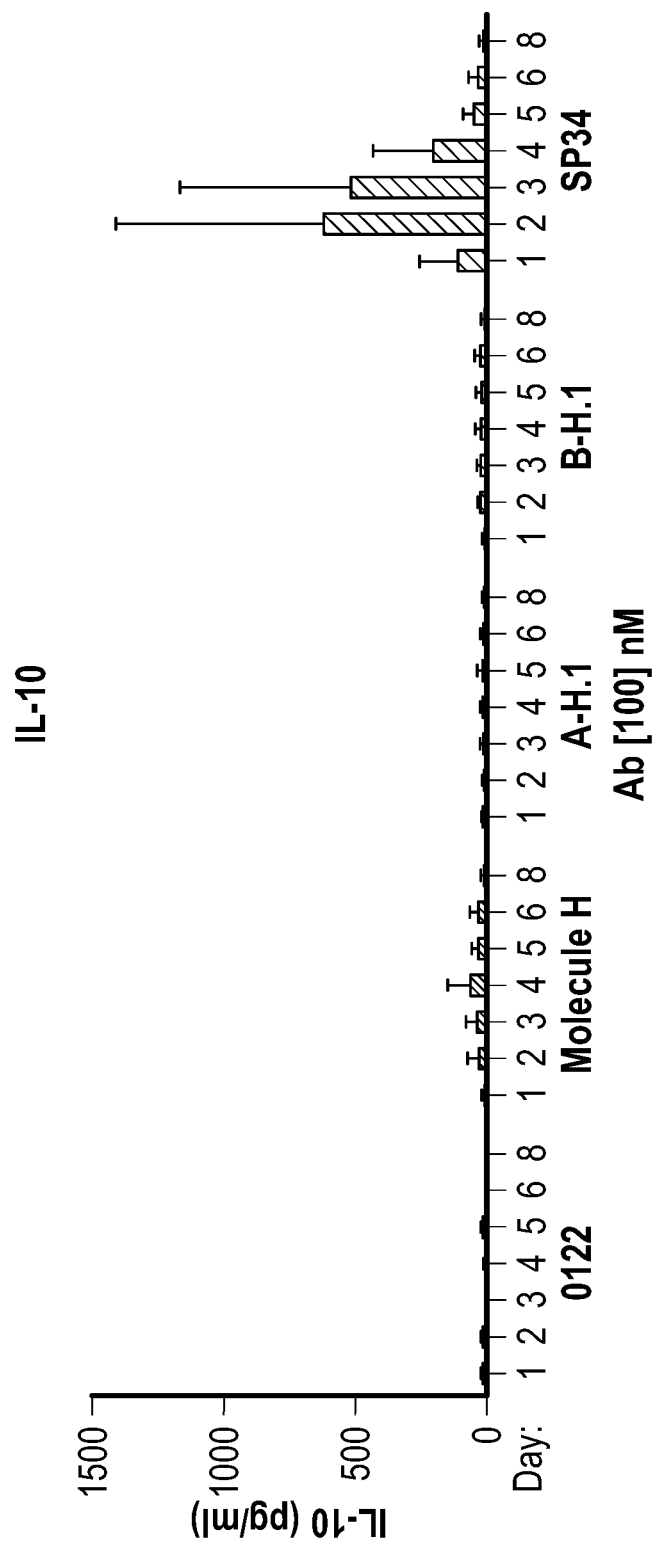

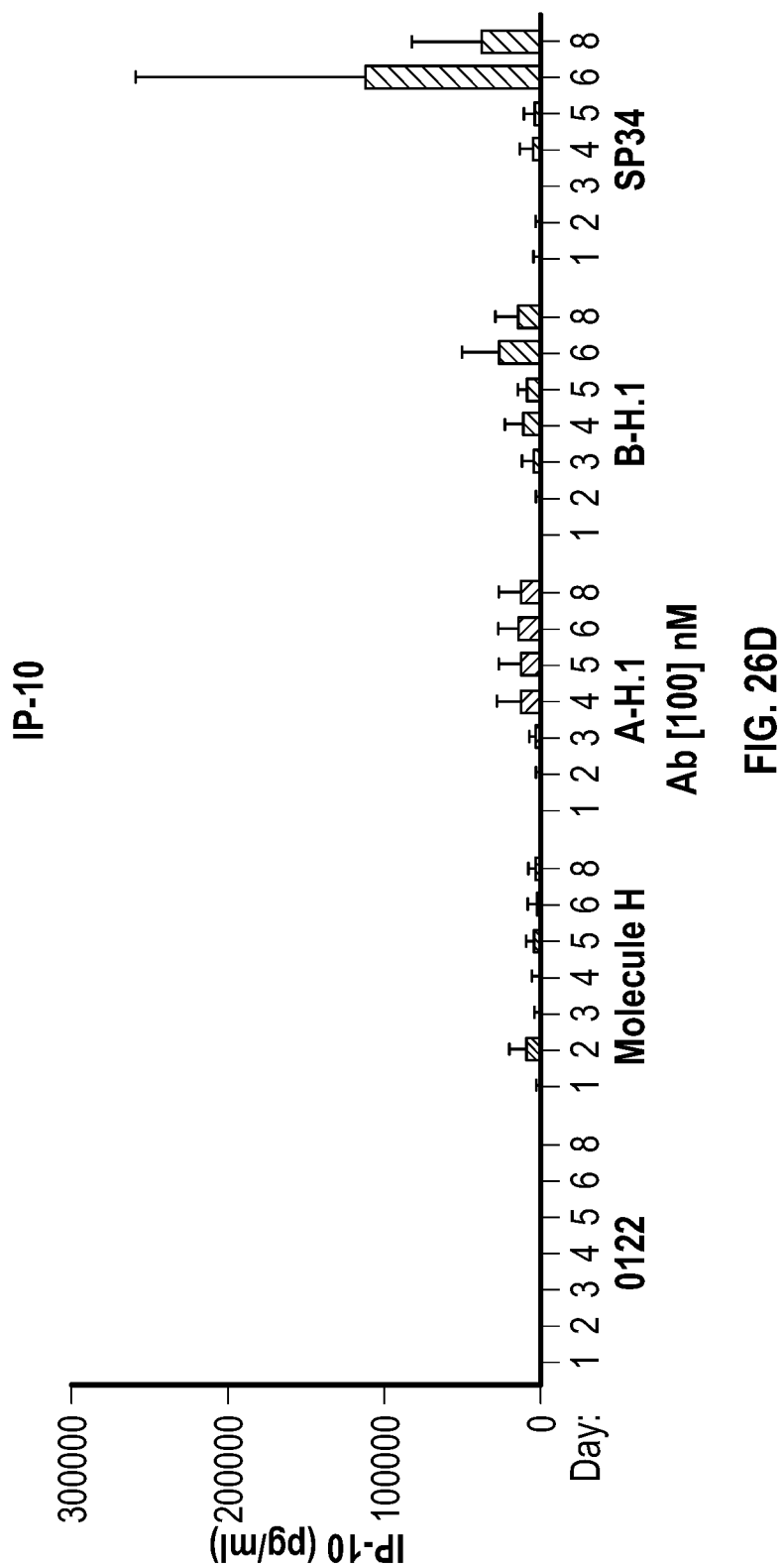

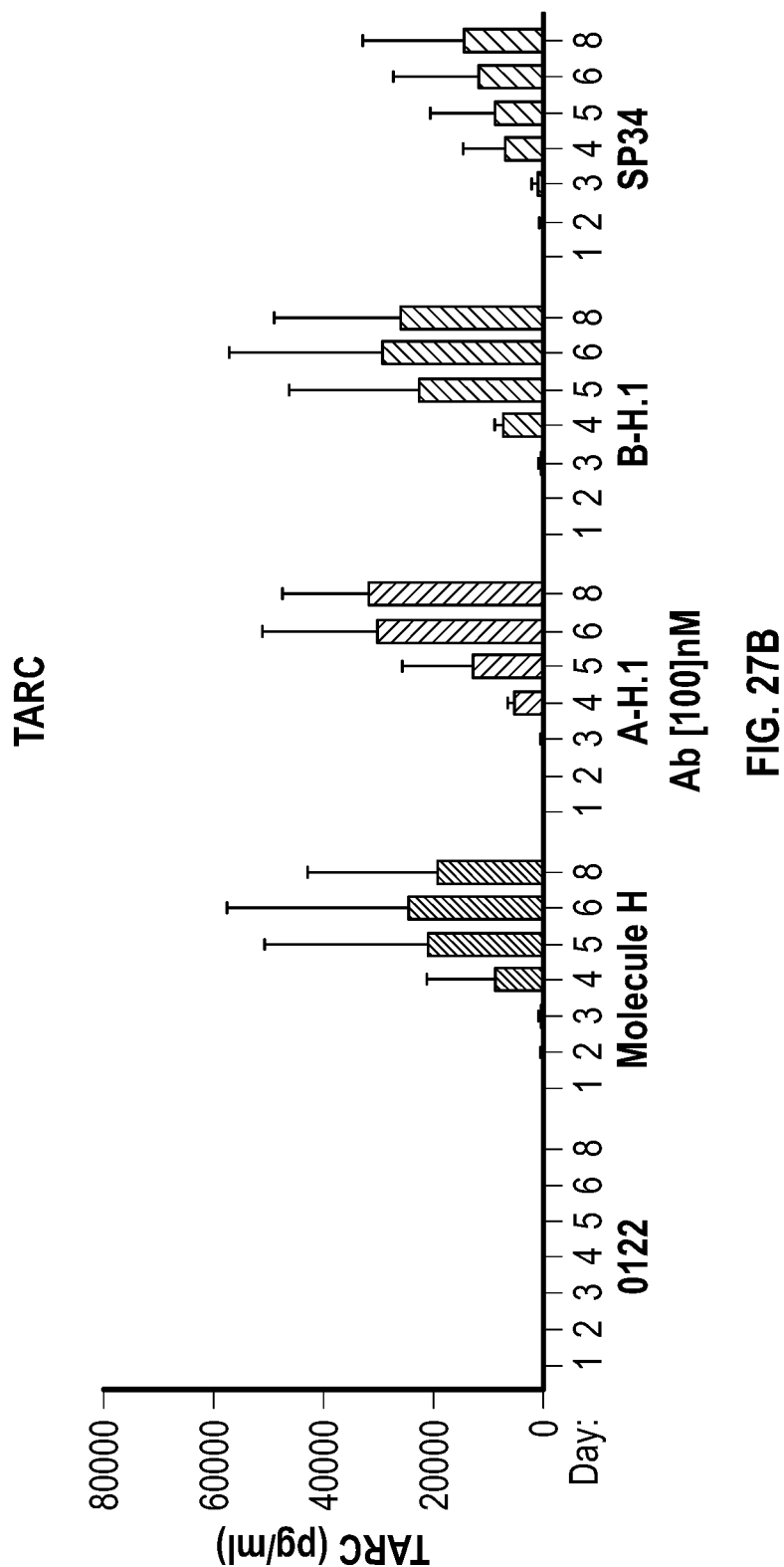

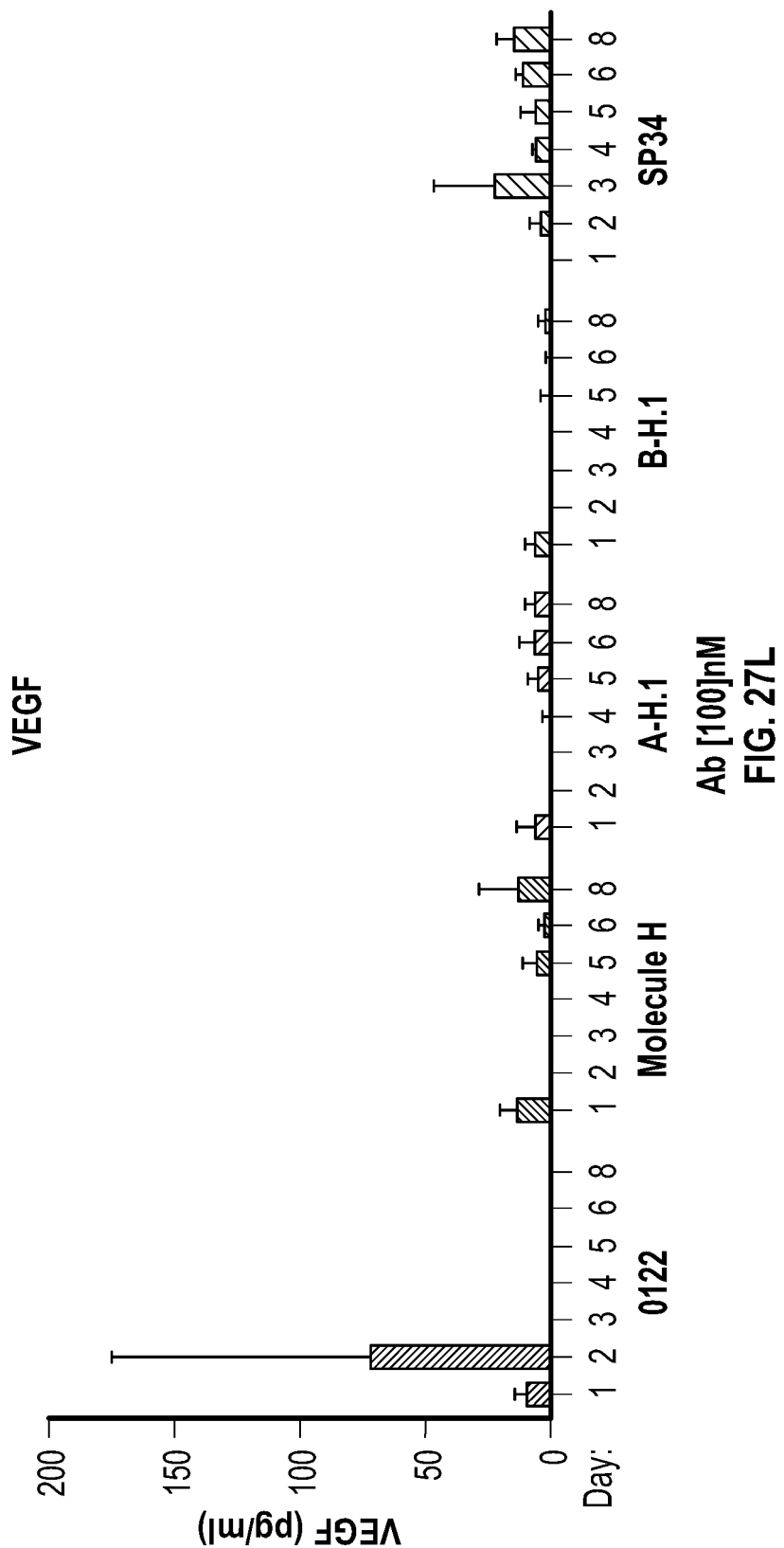

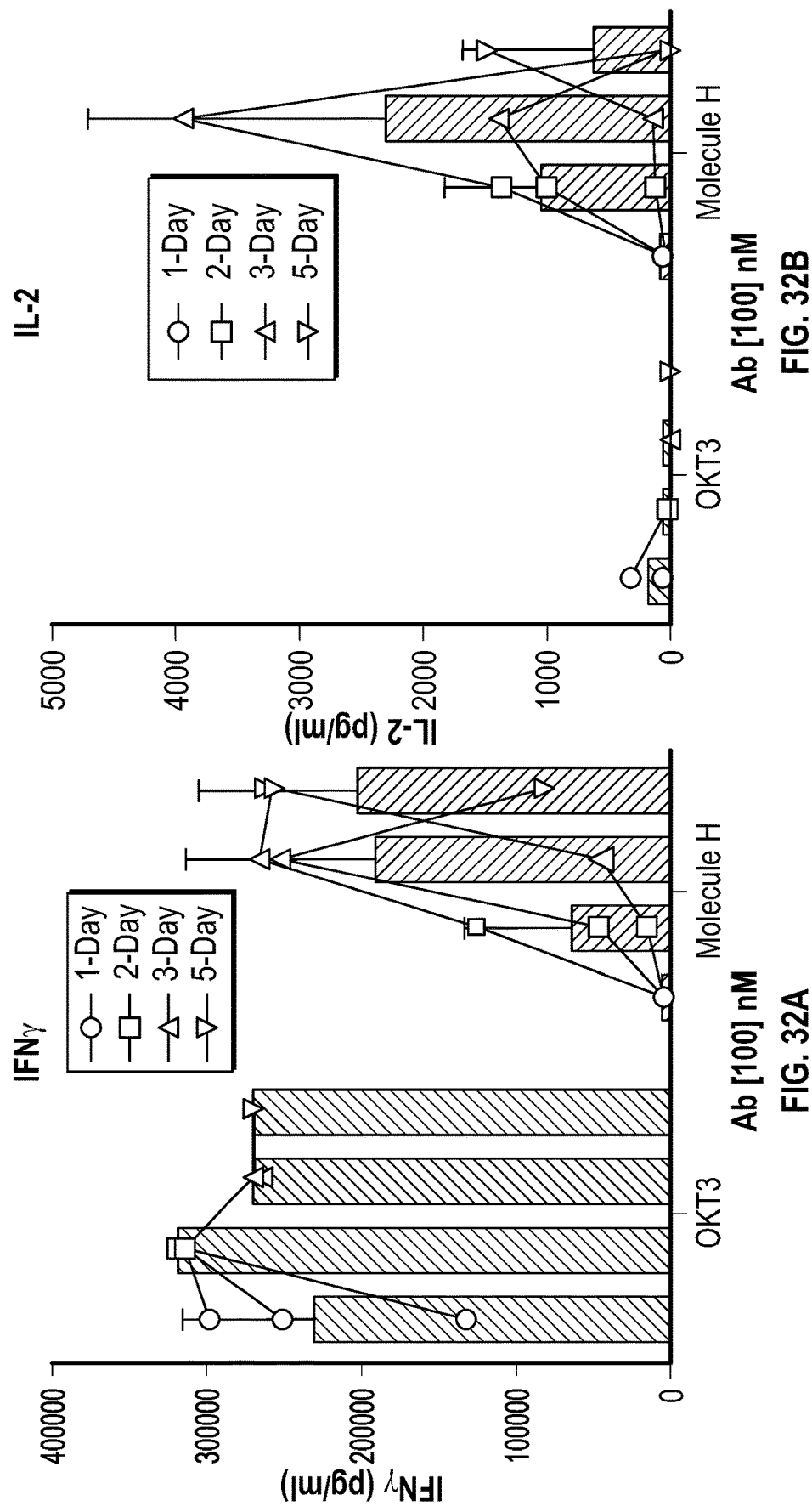

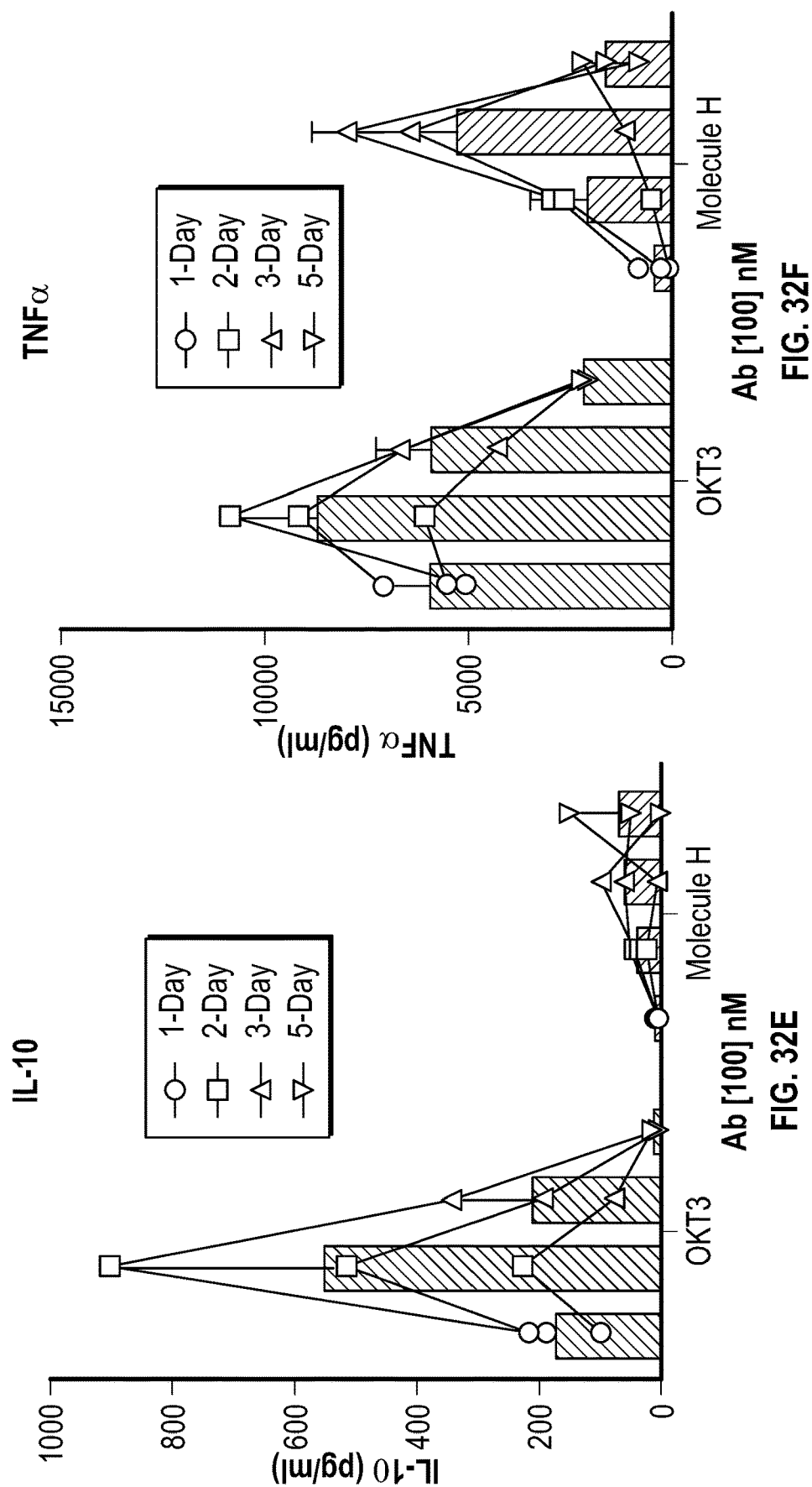

Table 9: Alignment of TCRBV amino acid sequences (SEQ ID NOS: 3457-3639, respectively, in order of appearance)

| | FR1-IMGT (1-26) | | CDR1-IMGT (27-38) | FR2-IMGT (39-55) | | CDR2-IMGT (56-65) | FR3-IMGT (66-104) | | | | CDR3-IMGT (105-117) |
|---|---|---|---|---|---|---|---|---|---|---|---|
| | A (1-15) | B (16-26) | BC (27-38) | C (39-46) | C' (47-55) | C'C" (56-65) | C" (66-74) | D (75-84) | E (85-96) | F (97-104) | FG (105-117) |
| Position | 1 ... 10 ... 15 | 16 ... 23 26 | 27 ... 38 | 39 41 ... 46 | 47 ... 55 | 56 ... 65 | 66 ... 74 | 75 ... 84 | 85 ... 89 ... 96 | 97 ... 104 | 105 |
| Gene | | | | | | | | | | | |
| TRBV1 | DTGITQTPKYLVTAM | GSKRTMKREHL | GH........DS | MYWYRQKA | KKSLEFMFY | YNC...KEF | IENKTVP.N | HFTPECP.DS | SRLYLHVVALQQ | EDSAAYLC | TSSQ |
| TRBV2 | EPEVTQTPSHQVTQM | GQEVILRCVPI | SNH.......LY | FYWYRQIL | GQKVEFLVS | FYN...NEI | SEKSEIFDD | QFSVERP.DG | SNFTLKIRSTKL | EDSAMYFC | ASSE |
| TRBV3-1 | DTAVSQTPKYLVTQM | GNDKSIKCEQN | LGH.......DT | MYWYKQDS | KKFIKIMFS | YNN...KEL | IINETVP.N | RFSPKSP.DK | AHLNLHINSLEL | GDSAVYFC | ASSQ |
| TRBV3-2 | DTAVSQTPKYLVTQM | GKKESLK*EQN | LGH.......NA | MYWYKQDS | KKFIKTMFI | YSN...KEP | ILNETVP.N | RFSPDSP.DK | AHLNLHINSLEL | GDSAVYFC | ASSQ |
| TRBV4-1 | DTEVTQTPKHLVMGM | TNKKSLKCEQH | MGH.......RA | MYWYKQKA | KKPELMFV | YSY...EKL | SINESVP.S | RFSPECP.NS | SLLNLHLHALQP | EDSALYLC | ASSQ |
| TRBV4-2 | ETGVTQTPRHLVMGM | TNKKSLKCEQH | LGH.......NA | MYWYKQSA | KKPLELMFV | YNF...KEQ | TENNSVP.S | RFSPECP.NS | SHLFLHLHTLQP | EDSALYLC | ASSQ |
| TRBV4-3 | ETGVTQTPRHLVMGM | TNKKSLKCEQH | LGH.......NA | MYWYKQSA | KKPLELMFV | YSL...EER | VENNSVP.S | RFSPECP.NS | SHLFLHLHTLQP | EDSALYLC | ASSQ |
| TRBV5-1 | KAGVTQTPRYLIKTR | GQQVTLSCSPI | SGH.......RS | VSWYQQTP | GQGLQFLFE | YFS...ETQ | RNKGNFP.G | RFSGRQF.SN | SRSEMNVSTLEL | GDSALYLC | ASSL |
| TRBV5-3 | EAGVTQSPTHLIKTR | GQQVTLRCSPI | SGH.......SS | VSWYQQAP | GQGPQFIFE | YAN...ELR | RSEGNFP.N | RFSGRQF.HD | CCSEMNVSALEL | GDSALYLC | ARSL |
| TRBV5-4 | ETGVTQSPTHLIKTR | GQQVTLRCSSQ | SGH.......NT | VSWYQQAL | GQGPQFIFQ | YYR...EEE | NGRGNFP.P | RFSGLQF.PN | YSSELNVNALEL | DDSALYLC | ASSL |
| TRBV5-5 | DAGVTQSPTHLIKTR | GQQVTLRCSPI | SGH.......KS | VSWYQQVL | GQGPQFIFQ | YYE...KEE | RGRGNFP.D | RFSARQF.PN | YSSELNVNALLL | GDSALYLC | ASSL |
| TRBV5-6 | DAGVTQSPTHLIKTR | GQQVTLRCSPK | SGH.......DT | VSWYQQAL | GQGPQFIFQ | YYE...EEE | RQRGNFP.D | RFSGHQF.PN | YSSELNVNALLL | GDSALYLC | ASSL |
| TRBV5-7 | DAGVTQSPTHLIKTR | GQHVTLRCSPI | SGH.......TS | VSSYQQAL | GQGPQFIFQ | YYE...KEE | RGRGNFP.D | QFSGHQF.PN | YSSELNVNALLL | GDSALYLC | ASSL |
| TRBV5-8 | EAGVTQSPTHLIKTR | GQQATLRCSPI | SGH.......TS | VYWYQQAL | GLGLQFLLW | YDE...GEE | RNRGNFP.P | RFSGRQF.PN | YSSELNVNALEL | EDSALYLC | ASSL |
| TRBV6-1 | NAGVTQTPKFQVLKT | GQSMTLQCAQD | MNH.......NS | MYWYRQDP | GMGLRLIYY | SAS...EGT | TDKGEVP.N | GYNVSRL.NK | REFSLRLESAAP | SQTSVYFC | ASSE |
| TRBV6-2 | NAGVTQTPKFRVLKT | GQSMTLLCAQD | MNH.......EY | MYWYRQDP | GMGLRLIHY | SVG...EGT | TAKGEVP.D | GYNVSRL.KK | QNFLLGLESAAP | SQTSVYFC | ASSY |
| TRBV6-3 | NAGVTQTPKFRVLKT | GQSMTLLCAQD | MNH.......EY | MYWYRQDP | GMGLRLIHY | SVG...EGT | TAKGEVP.D | GYNVSRL.KK | QNFLLGLESAAP | SQTSVYFC | ASSY |
| TRBV6-4 | IAGITQAPTSQILAA | GRRMTLRCTQD | MRH.......NA | MYWYRQDL | GLGLRLIHY | SNT...AGT | TGKGEVP.D | GYSVSRA.NT | DDFPLTLASAVP | SQTSVYFC | ASSD |

FIG. 34

| | | | | | |
|---|---|---|---|---|---|
| TRBV6-5 | NAGVTQTPKFQVLKT GQSMTLQCAQD MNH......EY MSWYRQDP GMGLRLIHY SVG...AGI TDQGEVP.N GYNVSRS.TT EDFPLRLLSAAP SQTSVYFC ASSY |
| TRBV6-6 | NAGVTQTPKFRILKI GQSMTLQCTQD MNH......NY MYWYRQDP GMGLKLIYY SVG...AGI TDKGEVP.N GYNVSRS.TT EDFPLRLELAAP SQTSVYFC ASSY |
| TRBV6-7 | NAGVTQTPKFHVLKT GQSMTLLCAQD MNH......EY MYRYRQDP GKGLRLIYY SVA...AAL TDKGEVP.N GYNVSRS.NT EDFPLKLESAAP SQTSVYFC ASSY |
| TRBV6-8 | NAGVTQTPKFHILKT GQSMTLQCAQD MNH......GY MSWYRQDP GMGLRLIHY SAA...AGT TDK.EVP.N GYNVSRL.NT EDFPLRLVSAAP SQTSVYFC ASSY |
| TRBV6-9 | NAGVTQTPKFHILKT GQSMTLQCAQD MNH......GY LSWYRQDP GMGLRRIHY SVA...AGI TDKGEVP.D GYNVSRS.NT EDFPLRLESAAP SQTSVYFC ASSY |
| TRBV7-1 | GAGVSQSLRHKVAKK GKDVALRYDPI SGH......NA LYWYRQSL GQGLEFPIY FQG...KDA ADKSGLPRD RFSAQRS.EG SISTLKFQRTQQ GDLAVYLC ASSS |
| TRBV7-2 | GAGVSQSPSNKVTEK GKDVELRCDPI SGH......TA LYWYRQSL GQGLEFLIY FQG...NSA PDKSGLPSD RFSAERT.GG SVSTLTIQRTQQ EDSAVYLC ASSL |
| TRBV7-3 | GAGVSQTPSNKVTEK GKYVELRCDPI SGH......TA LYWYRQSL GQGPEFLIY FQG...TGA ADDSGLPND RFFAVRP.EG SVSTLKIQRTER GDSAVYLC ASSL |
| TRBV7-4 | GAGVSQSPRYKVAKR GRDVALRCDSI SGH......VT LYWYRQTL GQGSEVLTY SQS...DAQ RDKSGRPSG RFSAERP.ER SVSTLKIQRTEQ GDSAVYLC ASSL |
| TRBV7-6 | GAGVSQSPRYKVTKR GQDVALRCDPI SGH......VS LYWYRQAL GQGPEFLTY FNY...EAQ QDKSGLPND RFSAERP.EG SISTLTIQRTEQ RDSAMYRC ASSL |
| TRBV7-7 | GAGVSQSPRYKVTKR GQDVTLRCDPI SSH......AT LYWYQQAL GQGPEFLTY FNY...EAQ PDKSGLPSD RFSAERP.EG SISTLTIQRTEQ RDSAMYLC ASSL |
| TRBV7-8 | GAGVSQSPRYKVAKR GQDVALRCDPI SGH......VS LFWYQQAL GQGPEFLTY FQN...EAQ LDKSGLPSD RFFAERP.EG SVSTLKIQRTEQ EDSAVYLC ASSL |
| TRBV7-9 | DTGVSQNPRHKITKR GQNVTFRCDPI SEH......NR LYWYRQTL GQGPEFLTY FQN...EAQ LEKSRLLSD RFSAERP.KG SFSTLEIQRTEQ GDSAMYLC ASSL |
| TRBV9 | DSGVTQTPKHLITAT GQRVTLRCSPR SGD......LS VYWYQQSL DQGLQFLIQ YYN...GEE RAKGNIL.E RFSAQQF.PD LHSELNLSSLEL GDSALYFC ASSV |
| TRBV10-1 | DAEITQSPRHKITET GRQVTLACHCQT WNH......NN MFWYRQDL GHGLRLIHY SYG...VQD TNKGEVS.D GYSVSRS.NT EDLPLTLESAAS SQTSVYFC ASSE |
| TRBV10-2 | DAGITQSPRYKITET GRQVTLMCHQT WSH......SY MFWYRQDL GHGLRLIYY SAA...ADI TDKGEVP.D GYVVSRS.KT ENFPLTLESATR SQTSVYFC ASSE |
| TRBV10-3 | DAGITQSPRHKVTET GTPVTLRCHQT ENH......RY MYWYRQDP GHGLRLIHY SYG...VKD TDKGEVS.D GYSVSRS.KT EDFLLTLESATS SQTSVYFC AISE |
| TRBV11-1 | EAEVAQSPRYKIEKR SQAVAFWCNPI SGH......AT LYWYRQIL GQGPELLVQ FQD...ESV VDDSQLPKD RFSAERL.KG VDSTLKIQPAEL GDSAMYLC ASSL |
| TRBV11-2 | EAGVAQSPRYKIIEK RQSVAFWCNPI SGH......AT LYWYQQIL GQGPKLLIQ FQN...NGV VDDSQLPKD RFSAERL.KG VDSTLKIQPAKL EDSAVYLC ASSL |
| TRBV11-3 | EAGVQSPRYKIIEK KQPVAFWCNPI SGH......NT LYWYLQNL GQGPELLIR YEN...EEA VDDSQLPKD RFSAERL.KG VDSTLKIQPAEL GDSAVYLC ASSL |
| TRBV12-1 | DAGVIQSPRHKVTEM GQSVTLRCEPI SGH......ND LLMYRQTF VQGLELLNY FCS...WTL VDDSGVSKD *FSAQMP.DV SFSTLRIQPMEP RDLGLYFC ASSF |
| TRBV12-2 | DAGIIQSPRHKVTEM GQTVTLRCEPI FGH......NF LFWYRDTF VQGLELLSY FRS...*SI IDNAGMPTE RFSAERP.DG SFSTLKIQPAEQ GDSAVYVC ASRL |
| TRBV12-3 | DAGVIQSPRHEVTEM GQEVTLRCKPI SGH......NS LFWYRQTM MRGLELLIY FNN...NVP IDDSGMPED RFSAKMP.NA SFSTLKIQPSEP RDSAVYFC ASSL |
| TRBV12-4 | DAGVIQSPRHEVTEM GQEVTLRCKPI SGH......DY LFWYRQTM MRGLELLIY FNN...NVP IDDSGMPED RFSAKMP.NA SFSTLKIQPSEP RDSAVYFC ASSL |
| TRBV12-5 | DARVTQTPRHKVTEM GQEVTMRCQPI LGH......NT VFWYRQTM MQGLELLAY FRN...RAP LDDSGMPKD RFSAEMP.DA TLATLKIQPSEP RDSAVYFC ASGL |
| TRBV13 | AAGVIQSPRHLIKEK RETATLKCYPI PRH......DT VYWYQQGP GDPQFLIS FYE...KMQ SDKGSIP.D RFSAQQF.SD YHSELNMSSLEL GDSALYFC ASSL |
| TRBV14 | EAGVTQFPSHSVIEK GQTVTLRCDPI SGH......DN LYWYRRVM GKEIKFLLH FVK...ESK QDESGMPNN RFLAERT.GG TYSTLKVQPAEL EDSGVYFC ASSQ |
| TRBV15 | DAMVIQNPRYQVTQF GKPVTLSCSQT LNH......NV MYWYQQKS SQAPKLLFH YYD...KDF NNEADTP.D NFQSRRP.NT SFCFLDIRSPGL GDTAMYLC ATSR |

FIG. 34 (continued)

| | | | | | |
|---|---|---|---|---|---|
| TRBV16 | GEEVAQTPKHLVRGE GQKAKLYCAPI KGH......SY VFWYQQVI KNEFKFLIS FQN...ENV FDETGMPKE RFSAKCL.PN SPCSLEIQATKL EDSAVYFC ASSQ |
| TRBV17 | EPGVSQTPRHKVTNM GQEVILRCDPS SGH......MF VHWYRQNL RQEMKLLIS FQY...QNI AVDSGMPKE RFTAERP.NG TSSTLKIHPAEP RDSAVILY SSG |
| TRBV18 | NAGVMQNPRHLVRRR GQEARLRCSPM KGH......SH VYWYRQLP EEGLKFMVY LQK...ENI IDESGMPKE RFSAEFP.KE GPSILRIQQVVR GDSAAYFC ASSP |
| TRBV19 | DGGITQSPKYLFRKE GQNVTLSCEQN LNH......DA MYWYRQDP GQGLRLIYY SQI...VND FQKGDIA.E GYSVSRE.KK ESFPLTVTSAQK NPTAFYLC ASSI |
| TRBV20-1 | GAVVSQHPSWVICKS GTSVKIECRSL DFQ.....ATT MFWYRQFP KQSLMLMAT SNEG...SKA TYEQGVEKD KFLINHA.SL TLSTLTVTSAHP EDSSFYIC SAR |
| TRBV21-1 | DTKVTQRPRLLVKAS EQKAKMDCVPI KAH......SY VYWYRKKL EEELKFLVY FQN...EEL IQKAEIINE RFLAQCS.KN SSCTLEIQSTES GDTALYFC ASSK |
| TRBV23-1 | HAKVTQTPGHLVKGK GQKTKMDCTPE KGH......TF VYWYQQNQ NKEFMLLIS FQN...EQV LQETEMHKK RFSSQCP.KN APCSLAILSSEP GDTALYLC ASSQ |
| TRBV24-1 | DADVTQTPRNRITKT GKRIMLECSQT KGH......DR MYWYRQDP GLGLRLIYY SFD...VKD INKGEIS.D GYSVSRQ.AQ AKFSLSLESAIP NQTALYFC ATSDL |
| TRBV25-1 | EADIYQTPRYLVIGT GKKITLECSQT MGH......DK MYWYQQDP GMELHLIHY SYG...VNS TEKGDLS.S ESTVSRI.RT EHFPLTLESARP SHTSQYLC ASSE |
| TRBV26 | DAVVTQFPRHRIIGT GKEFILQCSQN MNH......VT MYWYRQDP GLGLKLVYY SPG...TGS TEKGDIS.E GYHVS*N.TI ASFPLTLKSAST NQTSVYLY ASSS |
| TRBV27 | EAQVTQNPRYLITVT GKKLTVTCSQN MNH......EY MSWYRQDP GLGLRQIYY SMN...VEV TDKGDVP.E GYKVSRK.EK RNFPLILESPSP NQTSLYFC ASSL |
| TRBV28 | DVKVTQSSRYLVKRT GEKVFLECVQD MDH......EN MFWYRQDP GLGLRLIYF SYD...VKM KEKGDIP.E GYSVSRE.KK ERFSLILESAST NQTSMLLC ASSL |
| TRBV29-1 | SAVISQKPSRDICQR GTSLTIQCQVD SQV......TM MFWYRQQP GQSLTLIAT ANQG...SEA TYESGFVID KFPISRP.NL TFSTLTVSNMSP EDSSIYLC SVE |
| TRBV30 | SQTIHQWPATLVQPV GSPLSLECTVE GTS.....NPN LYWYRQAA GRGLQLLFY SVG.....IG QISSEVP.Q NLSASRP.QD RQFILSSKKLLL SDSGFYLC AWS |

FIG. 34 (continued)

Alignment of affinity matured humanized Antibody A-H VL sequences (SEQ ID NOS 3377-3389, respectively, in order of appearance)

```
a5-VL                         DIQMTQSPSFLSASVGDRVTITCKASQNVENKVAWHQQKPGKAPKALIYSSSHRYKGVPS 60
c1d2d4-VL                     DIQMTQSPSFLSASVGDRVTITCKASQNVDNKVAWHQQKPGKAPKALIYSSSHRYKGVPS 60
h3-VL                         DIQMTQSPSFLSASVGDRVTITCKASQNVDNRVAWHQQKPGKAPKALIYSSSHRYKGVPS 60
f5-VL                         DIQMTQSPSFLSASVGDRVTITCKASQNVEDRVAWHQQKPGKAPKALIYSSSHRYKGVPS 60
e4b6g3c6h2c2d1a6c3a3e6d6g2-VL DIQMTQSPSFLSASVGDRVTITCKASQNVDDRVAWYQQKPGKAPKALIYSSSHRYKGVPS 60
e3-VL                         DIQMTQSPSFLSASVGDRVTITCKASQNVGDRVAWYQQKPGKAPKALIYSSSHRYKGVPS 60
d5-VL                         DIQMTQSPSFLSASVGDRVTITCKASQNVEDKVAWYQQKPGKAPKALIYSSSHRYKGVPS 60
d3f1g1-VL                     DIQMTQSPSFLSASVGDRVTITCKASQNVADRVAWYQQKPGKAPKALIYSSSHRYKGVPS 60
c4f4f2a2a1-VL                 DIQMTQSPSFLSASVGDRVTITCKASQNVEDRVAWYQQKPGKAPKALIYSSSHRYKGVPS 60
b5h4a4-VL                     DIQMTQSPSFLSASVGDRVTITCKASQNVDNRVAWYQQKPGKAPKALIYSSSHRYKGVPS 60
b2c5b3e2g4h6-VL               DIQMTQSPSFLSASVGDRVTITCKASQNVGNRVAWYQQKPGKAPKALIYSSSHRYKGVPS 60
b1-VL                         DIQMTQSPSFLSASVGDRVTITCKASQNVGNRVAWYQQKPGKAPKALIYSSSHRYSGVPS 60
b4e1f3-VL                     DIQMTQSPSFLSASVGDRVTITCKASQNVGNRVAWYQQKPGKAPKALIYSSSHRYKGVPS 60
                              ***********************::  :::************ *** a5-VL                         RFSGSGSGTEFTLTISSLQPEDFATYFCQQFKSYPLTFGQGTKLEIK 107
c1d2d4-VL                     RFSGSGSGTEFTLTISSLQPEDFATYFCQQFKSYPLTFGQGTKLEIK 107
h3-VL                         RFSGSGSGTEFTLTISSLQPEDFATYFCQQFKSYPLTFGQGTKLEIK 107
f5-VL                         RFSGSGSGTEFTLTISSLQPEDFATYFCQQFKSYPLTFGQGTKLEIK 107
e4b6g3c6h2c2d1a6c3a3e6d6g2-VL RFSGSGSGTEFTLTISSLQPEDFATYFCQQFKSYPLTFGQGTKLEIK 107
e3-VL                         RFSGSGSGTEFTLTISSLQPEDFATYFCQQFKSYPLTFGQGTKLEIK 107
d5-VL                         RFSGSGSGTEFTLTISSLQPEDFATYFCQQFKSYPLTFGQGTKLEIK 107
d3f1g1-VL                     RFSGSGSGTEFTLTISSLQPEDFATYFCQQFKSYPLTFGQGTKLEIK 107
c4f4f2a2a1-VL                 RFSGSGSGTEFTLTISSLQPEDFATYFCQQFKSYPLTFGQGTKLEIK 107
b5h4a4-VL                     RFSGSGSGTEFTLTISSLQPEDFATYFCQQFKSYPLTFGQGTKLEIK 107
b2c5b3e2g4h6-VL               RFSGSGSGTEFTLTISSLQPEDFATYFCQQFKSYPLTFGQGTKLEIK 107
b1-VL                         RFSGSGSGTEFTLTISSLQPEDFATYFCQQFKSYPLTFGQGTKLEIK 107
b4e1f3-VL                     RFSGSGSGTEFTLTISSLQPEDFATYFCQQFKSYPLTFGQGTKLEIK 107
                              ***********************************************
```

Consensus VL: SEQ ID NO: 230
DIQMTQSPSFLSASVGDRVTITCKASQNV G/E/A/D N/D R/K VAW Y/H QQKPGKAPKALIYSSSHRY K/S GVPSRFSGSGSGTEFTLTISSLQPEDFATYFCQQFKSYPLTFGQGTKLEIK Consensus VL: SEQ ID NO: 3289
DIQMTQSPSFLSASVGDRVTITCKASQNV$X_1X_2X_3$VAW$X_4$QQKPGKAPKALIYSSSHRY$X_5$GVPSRFSGSGSGTEFTLTISSLQPEDFATYFCQQFKSYPLTFGQGTKLEIK, wherein $X_1$ is G, E, A or D; $X_2$ is N or D; $X_3$ is R or K; $X_4$ is Y or H; and $X_5$ is K or S

FIG. 35A

Alignment of affinity matured humanized Antibody A-H VH sequences (SEQ ID NOS 3390-3436, respectively, in order of appearance)

| | | |
|---|---|---|
| A-H.52-VH | QVQLVQSGAEVKKPGSSVKVSCKASGYSFTLGYIHWVRQAPGQGLEWMGWFFPGSGNIKY | 60 |
| A-H.53-VH | QVQLVQSGAEVKKPGSSVKVSCKASGYSFRLTYIHWVRQAPGQGLEWMGWFFPGSGNIKY | 60 |
| A-H.54-VH | QVQLVQSGAEVKKPGSSVKVSCKASGYSFHNWYIHWVRQAPGQGLEWMGWFFPGSGNIKY | 60 |
| A-H.51-VH | QVQLVQSGAEVKKPGSSVKVSCKASGYSFTTYIHWVRQAPGQGLEWMGWFFPGSGNIKY | 60 |
| A-H.50-VH | QVQLVQSGAEVKKPGSSVKVSCKASGYSFTTYYIHWVRQAPGQGLEWMGRIFPGSGNIKY | 60 |
| A-H.47-VH | QVQLVQSGAEVKKPGSSVKVSCKASGYSFTTYYIHWVRQAPGQGLEWMGWFFPGSGNTKY | 60 |
| A-H.49-VH | QVQLVQSGAEVKKPGSSVKVSCKASGYSFTTYYIHWVRQAPGQGLEWMGWFSPGSGNTKY | 60 |
| A-H.48-VH | QVQLVQSGAEVKKPGSSVKVSCKASGYSFTTYYIHWVRQAPGQGLEWMGWFSPGSGNTKY | 60 |
| A-H.45-VH | QVQLVQSGAEVKKPGSSVKVSCKASGYSFTTYYIHWVRQAPGQGLEWMGWFSAGSGNTKY | 60 |
| A-H.46-VH | QVQLVQSGAEVKKPGSSVKVSCKASGYSFTTYYIHWVRQAPGQGLEWMGWFSAGSGNTKY | 60 |
| c2-VH | QVQLVQSGAEVKKPGSSVKVSCKASGGTFRLTYIHWVRQAPGQGLEWMGRVPGSGNTKY | 60 |
| f5-VH | QVQLVQSGAEVKKPGSSVKVSCKASGHDFKLTYIHWVRQAPGQGLEWMGRVSPGSGNTKY | 60 |
| f3-VH | QVQLVQSGAEVKKPGSSVKVSCKASGTDFRLTYIHWVRQAPGQGLEWMGRISPGSGNTKY | 60 |
| e2-VH | QVQLVQSGAEVKKPGSSVKVSCKASGTDFKLTYIHWVRQAPGQGLEWMGRISPGSGNTKY | 60 |
| e1-VH | QVQLVQSGAEVKKPGSSVKVSCKASGTDFKLTYIHWVRQAPGQGLEWMGRISPGSGNVKY | 60 |
| c1-VH | QVQLVQSGAEVKKPGSSVKVSCKASGTDFKLTYIHWVRQAPGQGLEWMGRVSAGSGNVKY | 60 |
| a1-VH | QVQLVQSGAEVKKPGSSVKVSCKASGTDFRLTYIHWVRQAPGQGLEWMGRVSPGSGNVKY | 60 |
| b3-VH | QVQLVQSGAEVKKPGSSVKVSCKASGTDFKLTYIHWVRQAPGQGLEWMGRVSPGSGNVKY | 60 |
| h3-VH | QVQLVQSGAEVKKPGSSVKVSCKASGTDFKLTYIHWVRQAPGQGLEWMGRVSPGSGNVKY | 60 |
| c3-VH | QVQLVQSGAEVKKPGSSVKVSCKASGTDFRLTYIHWVRQAPGQGLEWMGRIFPGSGNTKY | 60 |
| a5b5c4-VH | QVQLVQSGAEVKKPGSSVKVSCKASGTDFKLTYIHWVRQAPGQGLEWMGRIFPGSGNTKY | 60 |
| d6-VH | QVQLVQSGAEVKKPGSSVKVSCKASGTDFRLTYIHWVRQAPGQGLEWMGRVSAGSGNVKY | 60 |
| h2-VH | QVQLVQSGAEVKKPGSSVKVSCKASGTFKLTYIHWVRQAPGQGLEWMGRVSAGSGNVKY | 60 |
| c5-VH | QVQLVQSGAEVKKPGSSVKVSCKASGTDFKLTYIHWVRQAPGQGLEWMGRISAGSGNTKY | 60 |
| f2-VH | QVQLVQSGAEVKKPGSSVKVSCKASGHDFRLTYIHWVRQAPGQGLEWMGRISAGSGNVKY | 60 |
| d3-VH | QVQLVQSGAEVKKPGSSVKVSCKASGHDFKLTYIHWVRQAPGQGLEWMGRISAGSGNVKY | 60 |
| a4e4-VH | QVQLVQSGAEVKKPGSSVKVSCKASGHDFKLTYIHWVRQAPGQGLEWMGRISAGSGNVKY | 60 |
| d2-VH | QVQLVQSGAEVKKPGSSVKVSCKASGHDFKLTYIHWVRQAPGQGLEWMGRISAGSGNVKY | 60 |
| g1-VH | QVQLVQSGAEVKKPGSSVKVSCKASGHDFDKTYIHWVRQAPGQGLEWMGRIYPGSGNVKY | 60 |
| c6-VH | QVQLVQSGAEVKKPGSSVKVSCKASGHDFDKTYIHWVRQAPGQGLEWMGRISAGSGNTKY | 60 |
| g2-VH | QVQLVQSGAEVKKPGSSVKVSCKASGTDFKTYIHWVRQAPGQGLEWMGRISAGSGNVKY | 60 |
| b4-VH | QVQLVQSGAEVKKPGSSVKVSCKASGTDFDKIYIHWVRQAPGQGLEWMGRVSAGSGNTKY | 60 |
| a6-VH | QVQLVQSGAEVKKPGSSVKVSCKASGHDFRLTYIHWVRQAPGQGLEWMGRISAGSGNVKY | 60 |
| a2g4-VH | QVQLVQSGAEVKKPGSSVKVSCKASGTDFDKIYIHWVRQAPGQGLEWMGRISAGSGNVKY | 60 |
| b6f1-VH | QVQLVQSGAEVKKPGSSVKVSCKASGTDFDKIYIHWVRQAPGQGLEWMGRISAGSGNVKY | 60 |
| g3-VH | QVQLVQSGAEVKKPGSSVKVSCKASGHDFDKIYIHWVRQAPGQGLEWMGRISAGSGNIKY | 60 |
| d1-VH | QVQLVQSGAEVKKPGSSVKVSCKASGHDFDKFYIHWVRQAPGQGLEWMGRISAGSGNTKY | 60 |
| h4-VH | QVQLVQSGAEVKKPGSSVKVSCKASGHDFDKFYIHWVRQAPGQGLEWMGRVSAGSGNVKY | 60 |
| b2-VH | QVQLVQSGAEVKKPGSSVKVSCKASGHDFDKFYIHWVRQAPGQGLEWMGRIFAGSGNVKY | 60 |

FIG. 35B

```
h6-VH      QVQLVQSGAEVKKPGSSVKVSCKASGTDFDKFYIHWVRQAPGQGLEWMGRVSAGSGNVKY    60
b1-VH      QVQLVQSGAEVKKPGSSVKVSCKASGHDFDKFYIHWVRQAPGQGLEWMGRVSAGSGNVKY    60
f4-VH      QVQLVQSGAEVKKPGSSVKVSCKASGHDFDKTYIHWVRQAPGQGLEWMGRVSAGSGNVKY    60
a3-VH      QVQLVQSGAEVKKPGSSVKVSCKASGHDFRDFYIHWVRQAPGQGLEWMGRVYPGSGSYRY    60
e6-VH      QVQLVQSGAEVKKPGSSVKVSCKASGHDFHLWYIHWVRQAPGQGLEWMGRVFAGSGNVKY    60
e3-VH      QVQLVQSGAEVKKPGSSVKVSCKASGHDFHLWYIHWVRQAPGQGLEWMGRISPGSGNVKY    60
d4-VH      QVQLVQSGAEVKKPGSSVKVSCKASGHDFHLWYIHWVRQAPGQGLEWMGRVSAGSGNVKY    60
d5-VH      QVQLVQSGAEVKKPGSSVKVSCKASGHDFHLWYIHWVRQAPGQGLEWMGRVFAGSGNTKY    60
           ********************** ** ** ******************* * ****  *

A-H.52-VH  NEKFKGRVTITADTSTSTAYMELSSLRSEDTAVYYCAGSYYSYDVLDYWGQGTTVTVSS   119
A-H.53-VH  NEKFKGRVTITADTSTSTAYMELSSLRSEDTAVYYCAGSYYSYDVLDYWGQGTTVTVSS   119
A-H.54-VH  NEKFKGRVTITADTSTSTAYMELSSLRSEDTAVYYCAGSIYSAGVLDYWGQGTTVTVSS   119
A-H.51-VH  NEKFKGRVTITADTSTSTAYMELSSLRSEDTAVYYCAGSIYSAGVLDYWGQGTTVTVSS   119
A-H.50-VH  NEKFKGRVTITADTSTSTAYMELSSLRSEDTAVYYCAGSYYSYDVLDYWGQGTTVTVSS   119
A-H.47-VH  NEKFKGRVTITADTSTSTAYMELSSLRSEDTAVYYCAGSYYSYDVLDYWGQGTTVTVSS   119
A-H.49-VH  NEKFKGRVTITADTSTSTAYMELSSLRSEDTAVYYCAVSYYSYDVLDYWGQGTTVTVSS   119
A-H.48-VH  NEKFKGRVTITADTSTSTAYMELSSLRSEDTAVYYCAVSYYSYDVLDYWGQGTTVTVSS   119
A-H.45-VH  NEKFKGRVTITADTSTSTAYMELSSLRSEDTAVYYCAGSYYSYDVLDYWGQGTTVTVSS   119
A-H.46-VH  NEKFKGRVTITADTSTSTAYMELSSLRSEDTAVYYCAGSYYSYDVLDYWGQGTTVTVSS   119
c2-VH      NEKFKGRVTITADTSTSTAYMELSSLRSEDTAVYYCAGSYYSYDVLDYWGQGTTVTVSS   119
f5-VH      NEKFKGRVTITADTSTSTAYMELSSLRSEDTAVYYCAGSYYSYDVLDYWGQGTTVTVSS   119
f3-VH      NEKFKGRVTITADTSTSTAYMELSSLRSEDTAVYYCAGSYYSYDVLDYWGQGTTVTVSS   119
e2-VH      NEKFKGRVTITADTSTSTAYMELSSLRSEDTAVYYCAGSYYSYDVLDYWGQGTTVTVSS   119
e1-VH      NEKFKGRVTITADTSTSTAYMELSSLRSEDTAVYYCAGSYYSYDVLDYWGQGTTVTVSS   119
c1-VH      NEKFKGRVTITADTSTSTAYMELSSLRSEDTAVYYCAGSYYSYDVLDYWGQGTTVTVSS   119
a1-VH      NEKFKGRVTITADTSTSTAYMELSSLRSEDTAVYYCAGSYYSYDVLDYWGQGTTVTVSS   119
b3-VH      NEKFKGRVTITADTSTSTAYMELSSLRSEDTAVYYCAGSYYSYDVLDYWGQGTTVTVSS   119
h3-VH      NEKFKGRVTITADTSTSTAYMELSSLRSEDTAVYYCAGSYYSYDVLDYWGQGTTVTVSS   119
c3-VH      NEKFKGRVTITADTSTSTAYMELSSLRSEDTAVYYCAGSYYSYDVLDYWGQGTTVTVSS   119
a5b5c4-VH  NEKFKGRVTITADTSTSTAYMELSSLRSEDTAVYYCAGSYYSYDVLDYWGQGTTVTVSS   119
d6-VH      NEKFKGRVTITADTSTSTAYMELSSLRSEDTAVYYCAGSYYSYDVLDYWGQGTTVTVSS   119
h2-VH      NEKFKGRVTITADTSTSTAYMELSSLRSEDTAVYYCAGSYYSYDVLDYWGQGTTVTVSS   119
c5-VH      NEKFKGRVTITADTSTSTAYMELSSLRSEDTAVYYCAGSYYSYDVLDYWGQGTTVTVSS   119
f2-VH      NEKFKGRVTITADTSTSTAYMELSSLRSEDTAVYYCAGSYYSYDVLDYWGQGTTVTVSS   119
d3-VH      NEKFKGRVTITADTSTSTAYMELSSLRSEDTAVYYCAGSYYSYDVLDYWGQGTTVTVSS   119
a4e4-VH    NEKFKGRVTITADTSTSTAYMELSSLRSEDTAVYYCAGSYYSYDVLDYWGQGTTVTVSS   119
d2-VH      NEKFKGRVTITADTSTSTAYMELSSLRSEDTAVYYCAGSYYSYDVLDYWGQGTTVTVSS   119
g1-VH      NEKFKGRVTITADTSTSTAYMELSSLRSEDTAVYYCAGSYYSYDVLDYWGQGTTVTVSS   119
c6-VH      NEKFKGRVTITADTSTSTAYMELSSLRSEDTAVYYCAGSYYSYDVLDYWGQGTTVTVSS   119
g2-VH      NEKFKGRVTITADTSTSTAYMELSSLRSEDTAVYYCAGSYYSYDVLDYWGQGTTVTVSS   119
b4-VH      NEKFKGRVTITADTSTSTAYMELSSLRSEDTAVYYCAGSYYSYDVLDYWGQGTTVTVSS   119
```

FIG. 35B (continued)

```
a6-VH       NEKFKGRVTITADTSTSTAYMELSSLRSEDTAVYYCAGSYYSYDVLDYWGQGTTVTVSS    119
a2g4-VH     NEKFKGRVTITADTSTSTAYMELSSLRSEDTAVYYCAGSYYSYDVLDYWGQGTTVTVSS    119
b6f1-VH     NEKFKGRVTITADTSTSTAYMELSSLRSEDTAVYYCAGSYYSYDVLDYWGQGTTVTVSS    119
g3-VH       NEKFKGRVTITADTSTSTAYMELSSLRSEDTAVYYCAGSYYSYDVLDYWGQGTTVTVSS    119
d1-VH       NEKFKGRVTITADTSTSTAYMELSSLRSEDTAVYYCAGSYYSYDVLDYWGQGTTVTVSS    119
h4-VH       NEKFKGRVTITADTSTSTAYMELSSLRSEDTAVYYCAGSYYSYDVLDYWGQGTTVTVSS    119
b2-VH       NEKFKGRVTITADTSTSTAYMELSSLRSEDTAVYYCAGSYYSYDVLDYWGQGTTVTVSS    119
h6-VH       NEKFKGRVTITADTSTSTAYMELSSLRSEDTAVYYCAGSYYSYDVLDYWGQGTTVTVSS    119
b1-VH       NEKFKGRVTITADTSTSTAYMELSSLRSEDTAVYYCAGSYYSYDVLDYWGQGTTVTVSS    119
f4-VH       NEKFKGRVTITADTSTSTAYMELSSLRSEDTAVYYCAGSYYSYDVLDYWGQGTTVTVSS    119
a3-VH       NEKFKGRVTITADTSTSTAYMELSSLRSEDTAVYYCAGSYYSYDVLDYWGQGTTVTVSS    119
e6-VH       NEKFKGRVTITADTSTSTAYMELSSLRSEDTAVYYCAGSYYSYDVLDYWGQGTTVTVSS    119
e3-VH       NEKFKGRVTITADTSTSTAYMELSSLRSEDTAVYYCAGSYYSYDVLDYWGQGTTVTVSS    119
d4-VH       NEKFKGRVTITADTSTSTAYMELSSLRSEDTAVYYCAGSYYSYDVLDYWGQGTTVTVSS    119
d5-VH       NEKFKGRVTITADTSTSTAYMELSSLRSEDTAVYYCAGSYYSYDVLDYWGQGTTVTVSS    119
            ***********************************************************
```

Consensus VH: SEQ ID NO: 231
QVQLVQSGAEVKKPGSSVKVSCKASG H/T/G/Y D/T/S F H/R/D/K/T L/D/K/T/N W/F/T/I/Y/G YIHWVRQAPGQGLEWMG R/W V/I/F F/S/Y A/P GSG N/S T/V/Y/I K/R YNEKFKGRVTITADTSTSTAYMELSSLRSEDTAVYYCA G/V S Y/I YS Y/A D/G VLDYWGQGTTVTVSS Consensus VH: SEQ ID NO: 3290
QVQLVQSGAEVKKPGSSVKVSCKASG$X_1X_2FX_3X_4X_5$YIHWVRQAPGQGLEWMG$X_6X_7X_8X_9$GSG$X_{10}X_{11}X_{12}$YNEKFKGRVTITADTSTSTAYMELSSLRSEDTAVYYCA$X_{13}SX_{14}YSX_{15}X_{16}$VLDYWGQGTTVTVSS, wherein: $X_1$ is H or T or G or Y; $X_2$ is D or T or S; $X_3$ is H or R or D or K or T; $X_4$ is L or D or K or T or N; $X_5$ is W or F or T or I or Y or G; $X_6$ is R or W; $X_7$ is V or I or F; $X_8$ is F or S or Y; $X_9$ is A or P; $X_{10}$ is N or S; $X_{11}$ is T or V or Y or I; $X_{12}$ is K or R; $X_{13}$ is G or V; $X_{14}$ is Y or I; $X_{15}$ is Y or A; and $X_{16}$ is D or G FIG. 35B (continued)

ANTI-TCR ANTIBODY MOLECULES AND USES THEREOF

CROSS-REFERENCE TO RELATED APPLICATIONS

This application is a U.S. National Phase Application under 35 U.S.C. § 371 of International Application NO. PCT/US2019/040592 filed on Jul. 3, 2019, which claims the benefit of U.S. Provisional Application 62/693,653 filed on Jul. 3, 2018, U.S. Provisional Application 62/737,829 filed on Sep. 27, 2018, U.S. Provisional Application 62/788,674 filed on Jan. 4, 2019, and U.S. Provisional Application 62/808,700 filed on Feb. 21, 2019, the entire contents of each of which are hereby incorporated by reference.

SEQUENCE LISTING

The instant application contains a Sequence Listing which has been submitted electronically in ASCII format and is hereby incorporated by reference in its entirety. Said ASCII copy, created on Sep. 16, 2019, is named E2070-7019WO_SL.txt and is 1,026,852 bytes in size.

BACKGROUND

Current molecules designed to redirect T cells to promote tumor cell lysis for cancer immunotherapy typically target the CD3 epsilon (CD3e) subunit of the T cell receptor (TCR). However, there are limitations to this approach. Previous studies have shown that, e.g., low doses of anti-CD3e monoclonal antibody (mAb) can cause T cell dysfunction and exert immunosuppressive effects. In addition, anti-CD3e mAbs bind to all T cells and thus activate a large number of T cells. Such non-physiological massive activation of T cells by these anti-CD3e mAbs can result in the production of proinflammatory cytokines such as IFN-gamma, IL-1-beta, IL-6, IL-10 and TNF-alpha, causing a "cytokine storm" known as the cytokine release syndrome (CRS), which is also associated with neurotoxicity (NT). Thus, it might be advantageous to develop antibodies that avoid or reduce CRS and/or NT.

SUMMARY OF THE INVENTION

Disclosed herein are, inter alia, antibody molecules directed to the variable chain of the beta subunit of TCR (TCRβV) which bind and, e.g., activate or expand, T cells, e.g., a subset of T cells ("anti-TCRβV antibody molecules"). In some embodiments, the anti-TCRβV antibody molecules disclosed herein result in a cytokine profile, e.g., a cytokine secretion profile, that differs from that of a T cell engager that binds to a receptor or molecule other than a TCRβV region ("a non-TCRβV-binding T cell engager"). In some embodiments, the anti-TCRβV antibody molecules disclosed herein result in lesser, minimal, or no production of cytokines associated with cytokine release syndrome (CRS), e.g., IL-6, IL-1beta, IL-10 and TNF alpha; and enhanced and/or delayed production of IL-2 and IFN-gamma. In some embodiments, the anti-TCRβV antibodies disclosed herein result in expansion of an immune cell, e.g., a T cell, a tumor infiltrating lymphocyte (TIL), an NK cell, or other immune cells (e.g., as described herein). Also provided herein are methods of making said anti-TCRβV antibody molecules, and methods of using said anti-TCRβV antibody molecules including, methods of using an anti-TCRβV antibody molecule for expanding an immune cell or an immune cell population, and method of using an anti-TCRβV antibody molecule for treating cancer, including the use as combination therapy with TIL and immune checkpoint therapeutics. This disclosure further provides multispecific molecules, e.g., bispecific molecules, comprising said anti-TCRβV antibody molecules. In some embodiments, compositions comprising anti-TCRβV antibody molecules of the present disclosure, can be used, e.g., to activate and/or redirect T cells to promote tumor cell lysis for cancer immunotherapy. In some embodiments, compositions comprising anti-TCRβV antibody molecules as disclosed herein limit the unwanted side-effects of CRS and/or NT, e.g., CRS and/or NT associated with anti-CD3e targeting.

In some embodiments, the anti-TCRβV antibody molecules disclosed herein result in lesser, minimal, or no production of cytokines associated with cytokine release syndrome (CRS), e.g., IL-6, IL-1beta, IL-10 and TNF alpha; and enhanced and/or delayed production of IL-2 and IFN-gamma, compared with an anti-CD3 antibody molecule (e.g., a low affinity anti-CD3 antibody molecule). In some embodiments, administration of the anti-TCRβV antibody molecules disclosed herein in a subject results in reduced cytokine release syndrome (CRS) (e.g., lesser duration of CRS or no CRS), a reduced severity of CRS (e.g., absence of severe CRS, e.g., CRS grade 4 or 5), reduced neurotoxicity (NT), or a reduced severity of NT, compared with similar administration of an anti-CD3 antibody molecule (e.g., a low affinity anti-CD3 antibody molecule).

Accordingly, provided herein are, anti-TCRβV antibody molecules, multispecific or multifunctional molecules (e.g., multispecific or multifunctional antibody molecules) (also referred to herein as a "composition") that comprise anti-TCRβV antibody molecules, nucleic acids encoding the same, methods of producing the aforesaid molecules, pharmaceutical compositions comprising aforesaid molecules, and methods of treating a disease or disorder, e.g., cancer, using the aforesaid molecules. The antibody molecules and pharmaceutical compositions disclosed herein can be used (alone or in combination with other agents or therapeutic modalities) to treat, prevent and/or diagnose disorders and conditions, e.g., cancer, e.g., as described herein.

In one aspect, the disclosure provides an antibody molecule, e.g., a non-murine, e.g., a human-like (e.g., a human, or humanized antibody molecule), which binds, e.g., specifically binds, to a T cell receptor beta variable (TCRβV) region.

In some embodiments, the anti-TCRBV antibody molecule comprises an antigen binding domain of an antibody disclosed in any of Tables 1-2, or 10-12, or a sequence with at least 85%, 90%, 95%, 96%, 97%, 98%, or 99% identity thereto. In some embodiments, the anti-TCRBV antibody molecule comprises a leader sequence comprising the amino acid sequence of SEQ ID NO: 3288. In some embodiments, the anti-TCRBV antibody molecule does not comprise a leader sequence comprising the amino acid sequence of SEQ ID NO: 3288.

In some embodiments, binding of the anti-TCRβV antibody molecule to a TCRβV region results in a cytokine profile, e.g., a cytokine secretion profile, (e.g., comprising one or more cytokines and/or one or more chemokines), that differs from that of a T cell engager that binds to a receptor or molecule other than a TCRβV region ("a non-TCRβV-binding T cell engager").

In some embodiments, the cytokine profile, e.g., cytokine secretion profile, comprises one, two, three, four, five, six, seven, or all of the following:

(i) increased level, e.g., expression level, and/or activity of IL-2;
(ii) reduced level, e.g., expression level, and/or activity of IL-1β;
(iii) reduced level, e.g., expression level, and/or activity of IL-6;
(iv) reduced level, e.g., expression level, and/or activity of TNFα;
(v) reduced level, e.g., expression level, and/or activity of IL-10;
(vi) a delay, e.g., at least 1, 2, 3, 4, 5, 6, 7, 8, 9, 10 or more hours delay, in increased level, e.g., expression level, and/or activity of IL-2;
(vii) a delay, e.g., at least 1, 2, 3, 4, 5, 6, 7, 8, 9, 10 hours delay, in increased level, e.g., expression level, and/or activity of IFN-gamma; or
(viii) increased level, e.g., expression level, and/or activity of IL-15, e.g., wherein (i)-(viii) are relative to the cytokine profile, e.g., cytokine secretion profile, of the non-TCRβV-binding T cell engager.

In some embodiments, binding of the anti-TCRBV antibody to a TCRβV region results in reduced cytokine storm, e.g., reduced cytokine release syndrome (CRS) and/or neurotoxicity (NT), as measured by an assay of Example 3, e.g., relative to the cytokine storm induced by the non-TCRβV-binding T cell engager.

In some embodiments, binding of the anti-TCRBV antibody to a TCRβV region results in one, two, three or all of:
(ix) reduced T cell proliferation kinetics;
(x) cell killing, e.g., target cell killing, e.g. cancer cell killing, e.g., as measured by an assay of Example 4;
(xi) increased Natural Killer (NK) cell proliferation, e.g., expansion; or
(xii) expansion, e.g., at least about 1.1-10 fold expansion (e.g., at least about 1.1, 1.2, 1.3, 1.4, 1.5, 2, 3, 4, 5, 6, 7, 8, 9, or 10 fold expansion), of a population of memory T cells, e.g., wherein (ix)-(xii) are relative to the non-TCRβV-binding T cell engager.

In some embodiments, an anti-TCRβV antibody molecule disclosed herein recognizes (e.g., binds to), a structurally conserved domain on the TCRβV protein (e.g., as denoted by the circled area in FIG. 24A).

In some embodiments, an anti-TCRβV antibody molecule disclosed herein does not recognize, e.g., bind to, an interface of a TCRβV:TCRalpha complex.

In some embodiments, an anti-TCRβV antibody molecule disclosed herein does not recognize, e.g., bind to, a constant region of a TCRβV protein. An exemplary antibody that binds to a constant region of a TCRBV region is JOVI.1 as described in Viney et al., (*Hybridoma*. 1992 December; 11(6):701-13).

In some embodiments, an anti-TCRβV antibody molecule disclosed herein does not recognize, e.g., bind to, one or more (e.g., all) of a complementarity determining region (e.g., CDR1, CDR2 and/or CDR3) of a TCRβV protein.

In some embodiments, binding of the anti-TCRβV antibody molecule to a TCRβV region results in one, two, three, four, five, six, seven, eight, nine, ten or more (e.g., all) of the following:
(i) reduced level, e.g., expression level, and/or activity of IL-1β;
(ii) reduced level, e.g., expression level, and/or activity of IL-6;
(iii) reduced level, e.g., expression level, and/or activity of TNFα;
(iv) increased level, e.g., expression level, and/or activity of IL-2;
(v) a delay, e.g., at least 1, 2, 3, 4, 5, 6, 7, 8, 9, 10 or more hours delay, in increased level, e.g., expression level, and/or activity of IL-2;
(vi) a delay, e.g., at least 1, 2, 3, 4, 5, 6, 7, 8, 9, 10 hours delay, in increased level, e.g., expression level, and/or activity of IFN-gamma;
(vii) reduced T cell proliferation kinetics;
(viii) reduced cytokine storm, e.g., cytokine release syndrome (CRS) and/or neurotoxicity (NT), e.g., as measured by an assay of Example 3;
(ix) cell killing, e.g., target cell killing, e.g. cancer cell killing, e.g., as measured by an assay of Example 4;
(x) increased level, e.g., expression level, and/or activity of IL-15; or
(xi) increased Natural Killer (NK) cell proliferation, e.g., expansion.

In some embodiments, any one or all of (i)-(xi) or any combination thereof resulting from an anti-TCRβV antibody molecule disclosed herein is compared to an antibody that binds to: a CD3 molecule, e.g., CD3 epsilon (CD3e) molecule; or a TCR alpha (TCRα) molecule.

In some embodiments, binding of the anti-TCRβV antibody molecule to a TCRβV region results in secretion, e.g., production of perforin and/or Granzyme B.

In an aspect, the disclosure provides an antibody molecule which binds, e.g., specifically binds, to a T cell receptor beta variable chain (TCRβV) region, wherein the anti-TCRβV antibody molecule comprises an antigen binding domain comprising:
(a) a light chain variable region (VL) comprising:
  (i) one, two or all of (e.g., three) a light chain complementarity determining region 1 (LC CDR1), a light chain complementarity determining region 2 (LC CDR2), and a light chain complementarity determining region 3 (LC CDR3) of SEQ ID NO: 10 or SEQ ID NO: 11; and
  (ii) a framework region (FR) having at least 95% identity with one, two, three, or all of (e.g., four) a non-murine germline framework 1 (FR1), a non-murine germline framework region 2 (FR2), a non-murine germline framework region 3 (FR3), and a non-murine germline framework region 4 (FR4); and/or
(b) a heavy chain variable region (VH) comprising:
  (i) one, two or all of (e.g., three) a heavy chain complementarity determining region 1 (HC CDR1), a heavy chain complementarity determining region 2 (HC CDR2) and a heavy chain complementarity determining region 3 (HC CDR3) of SEQ ID NO: 9; and
  (ii) a framework region (FR) having at least 95% identity with one, two, three, or all of (e.g., four) a non-murine germline framework 1 (FR1), a non-murine germline framework region 2 (FR2), a non-murine germline framework region 3 (FR3), and a non-murine germline framework region 4 (FR4).

In some embodiments, the VL comprises a sequence having a consensus sequence of SEQ ID NO: 230 or 3289.
In some embodiments, the VH comprises a sequence having a consensus sequence of SEQ ID NO: 231 or 3290.
In some embodiments, the anti-TCRβV antibody molecule binds to TCRβ V6, e.g., one or more of TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01, or a variant thereof.

In some embodiment, the anti-TCRβV antibody molecule comprises an antigen binding domain comprising:
(i) a HC CDR1, a HC CDR2 and a HC CDR3 of SEQ ID NO: 1 or SEQ ID NO: 9, or an amino acid sequence listed in Table 1; or
(ii) a LC CDR1, a LC CDR2, and a LC CDR3 of SEQ ID NO: 2, SEQ ID NO: 10 or SEQ ID NO: 11, or an amino acid sequence listed in Table 1.

In some embodiments, the anti-TCRβV antibody molecule comprises an antigen binding domain comprising a light chain variable region (VL) comprising one, two or all (e.g., three) of a LC CDR1, a LC CDR2 and a LC CDR3 of SEQ ID NO: 2, SEQ ID NO: 10 or SEQ ID NO: 11, or an amino acid sequence listed in Table 1.

In some embodiments, the anti-TCRβV antibody molecule comprises an antigen binding domain comprising a heavy chain variable region (VH) comprising one, two or all (e.g., three) of a HC CDR1, a HC CDR2 and a HC CDR3 of SEQ ID NO:1 or SEQ ID NO: 9, or an amino acid sequence listed in Table 1.

In some embodiments, the anti-TCRβV antibody molecule comprises an antigen binding domain comprising:
(i) a VL comprising: a LC CDR1 amino acid sequence of SEQ ID NO: 6 (or an amino acid sequence with not more than 1, 2, 3 or 4 modifications, e.g., substitutions, additions or deletions thereof), a LC CDR2 amino acid sequence of SEQ ID NO:7 (or an amino acid sequence with not more than 1, 2, 3 or 4 modifications, e.g., substitutions, additions or deletions thereof), and/or a LC CDR3 amino acid sequence of SEQ ID NO:8 (or an amino acid sequence with not more than 1, 2, 3 or 4 modifications, e.g., substitutions, additions or deletions thereof); and/or
(ii) a VH comprising: a HC CDR1 amino acid sequence of SEQ ID NO: 3 (or an amino acid sequence with not more than 1, 2, 3 or 4 modifications, e.g., substitutions, additions or deletions thereof), a HC CDR2 amino acid sequence of SEQ ID NO:4 (or an amino acid sequence with not more than 1, 2, 3 or 4 modifications, e.g., substitutions, additions or deletions thereof), and/or a HC CDR3 amino acid sequence of SEQ ID NO:5 (or an amino acid sequence with not more than 1, 2, 3 or 4 modifications, e.g., substitutions, additions or deletions thereof).

In some embodiments, the anti-TCRβV antibody molecule comprises an antigen binding domain comprising:
a variable heavy chain (VH) of an amino acid sequence listed in Table 1, e.g., SEQ ID NO: 9, or a sequence having at least about 85%, 90%, 95%, or 99% sequence identity to an amino acid sequence listed in Table 1, e.g., SEQ ID NO: 9; and/or
a variable light chain (VL) of an amino acid sequence listed in Table 1, e.g., SEQ ID NO: 10 or SEQ ID NO: 11, or a sequence having at least about 85%, 90%, 95%, or 99% sequence identity to an amino acid sequence listed in Table 1, e.g., SEQ ID NO: 10 or SEQ ID NO: 11.

In some embodiments, the anti-TCRβV antibody molecule comprises an antigen binding domain comprising:
(i) the VH amino acid sequence of SEQ ID NO: 9;
(ii) an amino acid sequence having at least about 85%, 90%, 95%, or 99% sequence identity to the amino acid sequence of SEQ ID NO: 9;
(iii) the VL amino acid sequence of SEQ ID NO: 10; and/or
(iv) an amino acid sequence having at least about 85%, 90%, 95%, or 99% sequence identity to the amino acid sequence of SEQ ID NO: 10.

In an aspect, provided herein is an antibody molecule which binds, e.g., specifically binds, to a T cell receptor beta variable chain (TCRβV) region, wherein the anti-TCRβV antibody molecule comprises an antigen binding domain comprising:
(a) a light chain variable region (VL) comprising:
(i) one, two or all of (e.g., three) a light chain complementarity determining region 1 (LC CDR1), a light chain complementarity determining region 2 (LC CDR2), and a light chain complementarity determining region 3 (LC CDR3) of a humanized B-H light chain (LC) of Table 2; and
(ii) a framework region (FR) having at least 95% identity with one, two, three or all (e.g., four) of a framework region 1 (FR1), a framework region 2 (FR2), a framework region 3 (FR3), and a framework region 4 (FR4) of a humanized B-H LC of Table 2; and/or
(b) a heavy chain variable region (VH) comprising:
(i) one, two or all of (e.g., three) a heavy chain complementarity determining region 1 (HC CDR1), a heavy chain complementarity determining region 2 (HC CDR2) and a heavy chain complementarity determining region 3 (HC CDR3) of a humanized B-H heavy chain (HC) of Table 2; and
(ii) a framework region (FR) having at least 95% identity with one, two, three or all (e.g., four) of a framework region 1 (FR1), a framework region 2 (FR2), a framework region 3 (FR3), and a framework region 4 (FR4) of a humanized B-H HC of Table 2.

In some embodiments, the anti-TCRBV binds to TCRβ V12, e.g., TCRβ V12-4*01, TCRβ V 12-3*01, or TCRβ V 12-5*01, or a variant thereof.

In some embodiment, the anti-TCRβV antibody molecule comprises an antigen binding domain comprising:
(i) a HC CDR1, a HC CDR2 and a HC CDR3 of Antibody B listed in Table 2; or
(ii) a LC CDR1, a LC CDR2, and a LC CDR3 of Antibody B listed in Table 2.

In some embodiments, the anti-TCRβV antibody molecule comprises an antigen binding domain comprising a light chain variable region (VL) comprising one, two or all (e.g., three) of a LC CDR1, a LC CDR2 and a LC CDR3 of SEQ ID NO: 2, SEQ ID NO: 10 or SEQ ID NO: 11, or an amino acid sequence listed in Table 1.

In some embodiments, the anti-TCRβV antibody molecule comprises an antigen binding domain comprising a heavy chain variable region (VH) comprising one, two or all (e.g., three) of a HC CDR1, a HC CDR2 and a HC CDR3 of a humanized B-H antibody listed in Table 2.

In some embodiments, the anti-TCRβV antibody molecule comprises an antigen binding domain comprising a light chain variable region (VL) comprising one, two or all (e.g., three) of a LC CDR1, a LC CDR2 and a LC CDR3 of a humanized B-H antibody listed in Table 2.

In some embodiments, the anti-TCRβV antibody molecule comprises:
a VH sequence of a humanized B-H antibody listed in Table 2, or a sequence having at least about 85%, 90%, 95%, or 99% sequence identity to a VH of a humanized B-H antibody listed in Table 2; and/or a VL sequence of a humanized B-H antibody listed in Table 2, or a sequence having at least about 85%, 90%, 95%, or 99% sequence identity to a VL of a humanized B-H antibody listed in Table 2.

In some embodiments, the anti-TCRβV antibody molecule comprises a framework region (FR) having at least 95% identity with one of: a FR1, a FR2, a FR3, and a FR4 of a humanized B-H LC of Table 2.

In some embodiments, the anti-TCRβV antibody molecule comprises a framework region (FR) having at least 95% identity with any two of: a FR1, a FR2, a FR3, and a FR4 of a humanized B-H LC of Table 2.

In some embodiments, the anti-TCRβV antibody molecule comprises a framework region (FR) having at least 95% identity with any three of: a FR1, a FR2, a FR3, and a FR4 of a humanized B-H LC of Table 2.

In some embodiments, the anti-TCRβV antibody molecule comprises a framework region (FR) having at least 95% identity with all of: a FR1, a FR2, a FR3, and a FR4 of a humanized B-H LC of Table 2.

In some embodiments, the anti-TCRβV antibody molecule comprises a framework region (FR) having at least 95% identity with one of: a FR1, a FR2, a FR3, and a FR4 of a humanized B-H HC of Table 2.

In some embodiments, the anti-TCRβV antibody molecule comprises a framework region (FR) having at least 95% identity with any two of: a FR1, a FR2, a FR3, and a FR4 of a humanized B-H HC of Table 2.

In some embodiments, the anti-TCRβV antibody molecule comprises a framework region (FR) having at least 95% identity with any three of: a FR1, a FR2, a FR3, and a FR4 of a humanized B-H HC of Table 2.

In some embodiments, the anti-TCRβV antibody molecule comprises a framework region (FR) having at least 95% identity with all of: a FR1, a FR2, a FR3, and a FR4 of a humanized B H HC of Table 2.

In another aspect, the disclosure provides a non-murine, e.g., a human-like antibody molecule (e.g., a human or humanized antibody molecule), which binds, e.g., specifically binds, to a T cell receptor beta variable (TCRβV) region. In some embodiments, binding of the anti-TCRβV antibody molecule results in expansion, e.g., at least about 1.1-50 fold expansion (e.g., at least about 1.5-40 fold, 2-35 fold, 3-30 fold, 5-25 fold, 8-20 fold, or 10-15 fold expansion), of a population of memory T cells, e.g., T effector memory (TEM) cells, e.g., TEM cells expressing CD45RA ($T_{EMRA}$) cells, e.g., CD4+ or CD8+$T_{EMRA}$ cells. In some embodiments, the expansion is at least about 1.1-10 fold expansion (e.g., at least about 1.1, 1.2, 1.3, 1.4, 1.5, 2, 3, 4, 5, 6, 7, 8, 9, or 10 fold expansion).

In some embodiments, expansion of the population of memory effector T cells, e.g., TEM cells, e.g., $T_{EMRA}$ cells, e.g., CD4+ or CD8+$T_{EMRA}$ cells, is compared to expansion of a similar population of cells with an antibody that binds to: a CD3 molecule, e.g., CD3 epsilon (CD3e) molecule; or a TCR alpha (TCRα) molecule.

In some embodiments, the population of expanded T effector memory cells comprises cells T cells, e.g., CD3+, CD8+ or CD4+ T cells. In some embodiments, the population of expanded T effector memory cells comprises CD3+ and CD8+ T cells. In some embodiments, the population of expanded T effector memory cells comprises CD3+ and CD4+ T cells.

In some embodiments, the population of expanded T effector memory (TEM) cells comprises cells T cells, e.g., CD3+, CD8+ or CD4+ T cells, which express or re-express, CD45RA, e.g., CD45RA+. In some embodiments, the population comprises TEM cells expressing CD45RA, e.g., $T_{EMRA}$ cells. In some embodiments, expression of CD45RA on $T_{EMRA}$ cells, e.g., CD4+ or CD8+$T_{EMRA}$ cells, can be detected by a method disclosed herein, e.g., flow cytometry.

In some embodiments, $T_{EMRA}$ cells have low or no expression of CCR7, e.g., CCR7- or CCR7 low. In some embodiments, expression of CCR7 on $T_{EMRA}$ cells cannot be detected by a method disclosed herein, e.g., flow cytometry.

In some embodiments, $T_{EMRA}$ cells express CD95, e.g., CD95+. In some embodiments, expression of CD95 on $T_{EMRA}$ cells can be detected by a method disclosed herein, e.g., flow cytometry.

In some embodiments, $T_{EMRA}$ cells express CD45RA, e.g., CD45RA+, have low or no expression of CCR7, e.g., CCR7- or CCR7 low, and express CD95, e.g., CD95+. In some embodiments $T_{EMRA}$ cells can be identified as CD45RA+, CCR7- and CD95+ cells. In some embodiments, $T_{EMRA}$ cells comprise CD3+, CD4+ or CD8+ T cells (e.g., CD3+ T cells, CD3+CD8+ T cells, or CD3+CD4+ T cells).

In some embodiments, binding of the anti-TCRβV antibody molecule results in expansion, e.g., at least about 1.1-50 fold expansion (e.g., at least about 1.5-40 fold, 2-35 fold, 3-30 fold, 5-25 fold, 8-20 fold, or 10-15 fold expansion), of a subpopulation of T cells. In some embodiments, the anti-TCRβV antibody molecule-activated (e.g., expanded) subpopulation of T cells resemble $T_{EMRA}$ cells in high expression of CD45RA and/or low expression of CCR7. In some embodiments, the anti-TCRβV antibody molecule-activated (e.g., expanded) subpopulation of T cells do not display upregulation of the senescence markers CD57 and/or KLRG1. In some embodiments, the anti-TCRβV antibody molecule-activated (e.g., expanded) subpopulation of T cells do not display upregulation of co-stimulatory molecules CD27 and/or CD28. In some embodiments, the anti-TCRβV antibody molecule-activated (e.g., expanded) subpopulation of T cells are highly proliferative. In some embodiments, the anti-TCRβV antibody molecule-activated (e.g., expanded) subpopulation of T cells secrete IL-2. In some embodiments, expression of surface markers on T cells can be detected by a method disclosed herein, e.g., flow cytometry. In some embodiments, the proliferative capability of T cells can be detected by a method disclosed herein, e.g., a method described in Example 4. In some embodiments, cytokine expression of T cells can be detected by a method disclosed herein, e.g., a method described in Examples 10 and 21. In some embodiments, the expansion is at least about 1.1-10 fold expansion (e.g., at least about 1.1, 1.2, 1.3, 1.4, 1.5, 2, 3, 4, 5, 6, 7, 8, 9, or 10 fold expansion). In some embodiments, the expansion is compared to expansion of a similar population of cells with an antibody that binds to a CD3 molecule, e.g., CD3 epsilon (CD3e) molecule; or a TCR alpha (TCRα) molecule.

In some embodiments, binding of the anti-TCRβV antibody molecule to a TCRβV region results in one, two, three, four, five, six, seven, eight, nine, ten or more (e.g., all) of the following:
  (i) reduced level, e.g., expression level, and/or activity of IL-1β;
  (ii) reduced level, e.g., expression level, and/or activity of IL-6;
  (iii) reduced level, e.g., expression level, and/or activity of TNFα;
  (iv) increased level, e.g., expression level, and/or activity of IL-2;
  (v) a delay, e.g., at least 1, 2, 3, 4, 5, 6, 7, 8, 9, 10 or more hours delay, in increased level, e.g., expression level, and/or activity of IL-2;

(vi) a delay, e.g., at least 1, 2, 3, 4, 5, 6, 7, 8, 9, 10 hours delay, in increased level, e.g., expression level, and/or activity of IFNg;
(vii) reduced T cell proliferation kinetics;
(viii) reduced cytokine storm, e.g., cytokine release syndrome (CRS) and/or neurotoxicity (NT), e.g., as measured by an assay of Example 3;
(ix) cell killing, e.g., target cell killing, e.g. cancer cell killing, e.g., as measured by an assay of Example 4;
(x) increased level, e.g., expression level, and/or activity of IL-15; or
(xi) increased Natural Killer (NK) cell proliferation, e.g., expansion,
compared to an antibody that binds to: a CD3 molecule, e.g., CD3 epsilon (CD3e) molecule; or a TCR alpha (TCRα) molecule.

In some embodiments of any of the compositions disclosed herein, binding of the anti-TCRβV antibody molecule to a TCRβV region results in a reduction of at least 2, 5, 10, 20, 50, 100, or 200 fold, or at least 2-200 fold (e.g., 5-150, 10-100, 20-50 fold) in the expression level and or activity of IL-10 as measured by an assay of Example 3.

In some embodiments of any of the compositions disclosed herein, binding of the anti-TCRβV antibody molecule to a TCRβV region results in a reduction of at least 2, 5, 10, 20, 50, 100, 200, 300, 400, 500, 600, 700, 800, 900, or 1000 fold, or at least 2-1000 fold (e.g., 5-900, 10 800, 20-700, 50-600, 100-500, or 200-400 fold) in the expression level and or activity of IL-6 as measured by an assay of Example 3.

In some embodiments of any of the compositions disclosed herein, binding of the anti-TCRβV antibody molecule to a TCRβV region results in a reduction of at least 2, 5, 10, 20, 50, 100, 200, 300, 400, 500, 600, 700, 800, 900, 1000, or 2000 fold, or at least 2-2000 fold (e.g., 5-1000, 10-900, 20-800, 50-700, 100-600, 200-500, or 300-400 fold) in the expression level and or activity of TNFα as measured by an assay of Example 3.

In some embodiments of any of the compositions disclosed herein, binding of the anti-TCRβV antibody molecule to a TCRβV region results in an increase of at least 2, 5, 10, 20, 50, 100, 200, 300, 400, 500, 600, 700, 800, 900, 1000, or 2000 fold, or at least 2-2000 fold (e.g., 5-1000, 10-900, 20-800, 50-700, 100-600, 200-500, or 300-400 fold) in the expression level and or activity of IL-2 as measured by an assay of Example 3.

In some embodiments of any of the compositions disclosed herein, binding of the anti-TCRβV antibody molecule to a TCRβV region results in an increase of at least 2, 5, 10, 20, 50, 100, 200, 300, 400, 500, 600, 700, 800, 900, 1000, or 2000 fold, or at least 2-2000 fold (e.g., 5-1000, 10-900, 20-800, 50-700, 100-600, 200-500, or 300-400 fold) in the expression level and or activity of IL-15 as measured by an assay of Example 4.

In some embodiments of any of the compositions disclosed herein, binding of the anti-TCRβV antibody molecule results in proliferation, e.g., expansion, e.g., at least about 1.1-50 fold expansion (e.g., at least about 1.5-40 fold, 2-35 fold, 3-30 fold, 5-25 fold, 8-20 fold, or 10-15 fold expansion), of a population of Natural Killer (NK) cells. In some embodiments, the expansion of NK cells is at least about 1.1-30 fold expansion (e.g., at least about 1.1, 1.2, 1.3, 1.4, 1.5, 2, 3, 4, 5, 6, 7, 8, 9, 10, 15, 20, 25, or at least about 1.1-5, 5-10, 10-15, 15-20, 20-25, or 25-30 fold expansion). In some embodiments, the expansion of NK cells is measure by an assay of Example 4. In some embodiments, the expansion of NK cells by, e.g., binding of, the anti-TCRβV antibody molecule is compared to expansion of an otherwise similar population not contacted with the anti-TCRβV antibody molecule.

In some embodiments of any of the compositions disclosed herein, binding of the anti-TCRβV antibody molecule results in cell killing, e.g., target cell killing, e.g. cancer cell killing. In some embodiments, the cancer cell is a hematological cancer cell or a solid tumor cell. In some embodiments, the cancer cell is a multiple myeloma cell. In some embodiments, binding of the anti-TCRβV antibody molecule results in cell killing in vitro or in vivo. In some embodiments, cell killing is measured by an assay of Example 4.

In some embodiments of any of the compositions disclosed herein, binding of the anti-TCRβV antibody molecule to a TCRβV region results in an increase or decrease of at least 2, 5, 10, 20, 50, 100, 200, 300, 400, 500, 600, 700, 800, 900, 1000, or 2000 fold, or at least 2-2000 fold (e.g., 5-1000, 10-900, 20-800, 50-700, 100-600, 200-500, or 300-400 fold) of any of the activities described herein compared the activity of 16G8 or TM23 murine antibody, or a humanized version thereof as described in U.S. Pat. No. 5,861,155.

In an aspect, provided herein is an antibody molecule which binds, e.g., specifically binds, to a T cell receptor beta variable chain (TCRβV) region (an anti-TCRβV antibody molecule), wherein the anti-TCRβV antibody molecule:
(i) binds specifically to an epitope on TCRβV, e.g., the same or similar epitope as the epitope recognized by an anti-TCRβV antibody molecule as described herein, e.g., a second anti-TCRβV antibody molecule;
(ii) shows the same or similar binding affinity or specificity, or both, as an anti-TCRβV antibody molecule as described herein, e.g., a second anti-TCRβV antibody molecule;
(iii) inhibits, e.g., competitively inhibits, the binding of an anti-TCRβV antibody molecule as described herein, e.g., a second anti-TCRβV antibody molecule;
(iv) binds the same or an overlapping epitope with an anti-TCRβV antibody molecule as described herein, e.g., a second anti-TCRβV antibody molecule; or
(v) competes for binding, and/or binds the same epitope, with an anti-TCRβV antibody molecule as described herein, e.g., a second anti-TCRβV antibody molecule, In some embodiments, the second anti-TCRβV antibody molecule comprises an antigen binding domain chosen from Table 1 or Table 2, or a sequence substantially identical thereto. In some embodiments, the second anti-TCRβV antibody molecule comprises an antigen binding domain, comprising:

a heavy chain complementarity determining region 1 (HC CDR1), a heavy chain complementarity determining region 2 (HC CDR2) and/or a heavy chain complementarity determining region 3 (HC CDR3) of SEQ ID NO: 1 or SEQ ID NO: 9; and/or a light chain complementarity determining region 1 (LC CDR1), a light chain complementarity determining region 2 (LC CDR2), and/or a light chain complementarity determining region 3 (LC CDR3) of SEQ ID NO: 2, SEQ ID NO: 10 or SEQ ID NO: 11.

In some embodiments of any of the compositions disclosed herein, binding of the anti-TCRβV antibody molecule to a TCRβV region results in a change in any (e.g., one, two, three, four or all) of (i)-(v) that is different, e.g., an increase or decrease, of at least 2, 5, 10, 20, 50, 100-fold, compared the activity of 16G8 or TM23 murine antibody or a humanized version thereof as described in U.S. Pat. No. 5,861,155.

In some embodiments of any of the compositions disclosed herein, the anti-TCRβV antibody molecule binds to a TCRBV family (e.g., gene family), e.g., a TCRBV gene family comprising subfamilies, e.g., as described herein. In some embodiments, the TCRBV family, e.g., gene family, comprises: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 v, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, a TCRβ V29 subfamily, a TCRβ V23 subfamily, a TCRβ V21 subfamily, a TCRβ V1 subfamily, a TCRβ V17 subfamily, or a TCRβ V26 subfamily.

In some embodiments, the anti-TCRβV antibody binds to a TCRβ V6 subfamily chosen from: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments the TCRβ V6 subfamily comprises TCRβ V6-5*01.

In some embodiments, the anti-TCRβV antibody binds to a TCRβ V10 subfamily chosen from: TCRβ V10-1*01, TCRβ V10-1*02, TCRβ V10-3*01 or TCRβ V10-2*01.

In some embodiments, the anti-TCRβV antibody binds to a TCRβ V12 subfamily chosen from: TCRβ V12-4*01, TCRβ V12-3*01 or TCRβ V12-5*01.

In some embodiments of any of the compositions disclosed herein, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments of any of the compositions disclosed herein, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments of any of the compositions disclosed herein, the anti-TCRβV antibody molecule binds to a TCRβV region other than TCRβ V12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments of any of the compositions disclosed herein, the anti-TCRβV antibody molecule does not comprise at least one CDR of Antibody B. In some embodiments of any of the compositions disclosed herein, the anti-TCRβV antibody molecule does not comprise the CDRs of Antibody B.

In some embodiments of any of the compositions disclosed herein, the anti-TCRβV antibody binds to a TCRβ V5 subfamily chosen from: TCRβ V5-5*01, TCRβ V5-6*01, TCRβV5-4*01, TCRβ V5-8*01, TCRβ V5-1*01.

In some embodiments of any of the compositions disclosed herein, the anti-TCRβV antibody binds to a TCRβ V5 subfamily chosen from: TCRβ V5-5*01, TCRβ V5-6*01, TCRβV5-4*01, TCRβ V5-8*01, TCRβ V5-1*01.

In some embodiments of any of the compositions disclosed herein, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments of any of the compositions disclosed herein, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments of any of the compositions disclosed herein, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments of any of the compositions disclosed herein, the anti-TCRβV antibody molecule does not comprise at least one CDR of the TM23 murine antibody. In some embodiments of any of the compositions disclosed herein, the anti-TCRβV antibody molecule does not comprise the CDRs of the TM23 murine antibody.

In some embodiments of any of the compositions disclosed herein, an anti-TCRβV antibody molecule disclosed herein does not comprise the sequence of a murine anti-rat TCR antibody R73, e.g., as disclosed in J Exp Med. 1989 Jan. 1; 169(1): 73-86, herein incorporated by reference in its entirety. In some embodiments of any of the compositions disclosed herein, a multispecific antibody molecule disclosed herein does not comprise the sequence of a murine anti-rat TCR antibody R73, e.g., as disclosed in J Immunol. 1993 Mar. 15; 150(6):2305-15, herein incorporated by reference in its entirety.

In some embodiments of any of the compositions disclosed herein, an anti-TCRβV antibody molecule disclosed herein does not comprise a viral peptide-MHC complex, e.g., as disclosed in Oncoimmunology. 2016; 5(1): e1052930, herein incorporated by reference in its entirety. In some embodiments of any of the compositions disclosed herein, a multispecific antibody molecule disclosed herein does not comprise a viral peptide-MHC complex, e.g., as disclosed in Oncoimmunology. 2016; 5(1): e1052930, herein incorporated by reference in its entirety.

In some embodiments of any of the compositions disclosed herein, the anti-TCRβV antibody molecule binds to one or more (e.g., all) of the following TCRβV subfamilies:
  (i) TCRβ V6 subfamily comprising, e.g., one or more of TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01;
  (ii) TCRβ V10 subfamily comprising, e.g., one or more of TCRβ V10-101, TCRβ V10-1*02, TCRβ V10-3*01 or TCRβ V10-2*01;

(iii) TCRβ V5 subfamily comprising, e.g., one or more of TCRβ V5-6*01, TCRβ V5-4*01, or TCRβ V5-8*01;
(iv) TCRβ V12 subfamily comprising e.g., one or more of TCRβ V12-4*01, TCRβ V12-3*01, or TCRβ V12-5*01;
(v) TCRβ V7 subfamily comprising e.g., one or more of TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01;
(vi) TCRβ V11 subfamily comprising e.g., one or more of TCRβ V11-1*01, TCRβ V11-2*01 or TCRβ V11-3*01;
(vii) TCRβ V14 subfamily comprising TCRβ V14*01;
(viii) TCRβ V16 subfamily comprising TCRβ V16*01;
(ix) TCRβ V18 subfamily comprising TCRβ V18*01;
(x) TCRβ V9 subfamily comprising T e.g., one or more of CRP V9*01 or TCRβ V9*02;
(xi) TCRβ V13 subfamily comprising TCRβ V13*01;
(xii) TCRβ V4 subfamily comprising e.g., one or more of e.g., one or more of TCRβ V4-2*01, TCRβ V4-3*01, or TCRβ V4-1*01;
(xiii) TCRβ V3 subfamily comprising TCRβ V3-1*01;
(xiv) TCRβ V2 subfamily comprising TCRβ V2*01;
(xv) TCRβ V15 subfamily comprising TCRβ V 15*01;
(xvi) TCRβ V30 subfamily comprising e.g., one or more of TCRβ V30*01, or TCRβV30*02;
(xvii) TCRβ V19 subfamily comprising e.g., one or more of TCRβ V19*01, or TCRβV19*02;
(xviii) TCRβ V27 subfamily comprising TCRβ V27*01;
(xix) TCRβ V28 subfamily comprising TCRβ V28*01;
(xx) TCRβ V24 subfamily comprising TCRβ V24-1*01;
(xxi) TCRβ V20 subfamily comprising e.g., one or more of TCRβ V20-1*01, or TCRβV20-1*02;
(xxii) TCRβ V25 subfamily comprising TCRβ V25-1*01; or
(xxiii) TCRβ V29 subfamily comprising TCRβ V29-1*01;
(xxiv) TCRβ V21 subfamily;
(xxv) TCRβ V1 subfamily;
(xxvi) TCRβ V17 subfamily;
(xvii) TCRβ V23 subfamily; or
(xviii) TCRβ V26 subfamily.

In some embodiments of any of the compositions disclosed herein, the anti-TCRβV antibody molecule binds to one or more (e.g., all) of the following TCRβV subfamilies:
(i) TCRβ V6, e.g., one or more of TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01;
(ii) TCRβ V10, e.g., one or more of TCRβ V10-1*01, TCRβ V10-1*02, TCRβ V10-3*01 or TCRβ V10-2*01;
(iii) TCRβ V12, e.g., one or more of TCRβ V 12-4*01, TCRβ V 12-3*01, or TCRβ V12-5*01; or
(iv) TCRβ V5, e.g., one or more of TCRβ V5-5*01, TCRβ V5-6*01, TCRβ V5-4*01, TCRβ V5-8*01, TCRβ V5-1*01.

In some embodiments, the anti-TCRβV antibody molecule binds to TCRβ V6, e.g., one or more of TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, the anti-TCRβV antibody molecule binds to TCRβ V6-5*01.

In some embodiments, the anti-TCRβV antibody molecule does not bind to TCRβ V12.

In some embodiments, the anti-TCRβV antibody molecule does not bind to TCRβ V5-5*01 or TCRβ V5-1*01.

In an aspect, provided herein is a multispecific molecule (e.g., a bispecific molecule), comprising a first moiety (e.g., a first immune cell engager) comprising an antibody molecule which binds (e.g., specifically binds) to a T cell receptor beta variable region (TCRβV) ("anti-TCRβV antibody molecule").

In some embodiments, the multispecific molecule comprises a second moiety which comprises one or more of: a tumor-targeting moiety, a cytokine molecule, a stromal modifying moiety, or an anti-TCRβV antibody molecule other than the first moiety.

In some embodiments, binding of the first moiety to the TCRβV region results in a cytokine profile, e.g., cytokine secretion profile, that differs from that of a T cell engager that binds to a receptor or molecule other than a TCRβV region ("a non-TCRβV-binding T cell engager").

In another aspect, the disclosure provides a multispecific molecule, e.g., a bispecific molecule, comprising the anti-TCRβV antibody molecule disclosed herein.

In some embodiments, the multispecific molecule further comprises: a tumor-targeting moiety, a cytokine molecule, an immune cell engager, e.g., a second immune cell engager, and/or a stromal modifying moiety.

In yet another aspect, disclosed herein is a multispecific molecule, e.g., a bispecific molecule, comprising:
(i) a first moiety comprising a first immune cell engager comprising an anti-TCRβV antibody molecule disclosed herein; and
(ii) a second moiety comprising one or more of: a tumor-targeting moiety; a second immune cell engager; a cytokine molecule or a stromal modifying moiety.

In another aspect, the disclosure provides an isolated nucleic acid molecule comprising a nucleotide sequence encoding an anti-TCRβV antibody molecule disclosed herein, or a nucleotide sequence having at least 75%, 80%, 85%, 90%, 95%, or 99% identity thereto.

In another aspect, the disclosure provides an isolated nucleic acid molecule comprising a nucleotide sequence encoding a multispecific molecule disclosed herein, or a nucleotide sequence having at least 75%, 80%, 85%, 90%, 95%, or 99% identity thereto.

In yet another aspect, the disclosure provides a vector, e.g., an expression vector, comprising a nucleotide sequence encoding an anti-TCRβV antibody molecule disclosed herein, or a nucleotide sequence having at least 75%, 80%, 85%, 90%, 95%, or 99% identity thereto.

In another aspect, the disclosure provides a vector, e.g., an expression vector, comprising a nucleotide sequence encoding a multispecific molecule disclosed herein, or a nucleotide sequence having at least 75%, 80%, 85%, 90%, 95%, or 99% identity thereto.

In one aspect, the disclosure provides a cell, e.g., host cell, e.g., a population of cells, comprising a nucleic acid molecule encoding an anti-TCRβV antibody molecule disclosed herein, or a nucleotide sequence having at least 75%, 80%, 85%, 90%, 95%, or 99% identity thereto. In some embodiments, the cell or population of cells comprising a nucleic acid molecule encoding anti-TCRβV antibody molecule, comprises: (i) a heavy chain comprising: a variable region (VH), e.g., a VH listed in Table 1 or 2, or a sequence having at least 75%, 80%, 85%, 90%, 95%, or 99% identity thereto; and one or more heavy chain constant regions, e.g., as described herein; and/or (ii) a light chain comprising: a variable region (VL) e.g., a VL listed in Table 1 or 2, or a sequence having at least 75%, 80%, 85%, 90%, 95%, or 99% identity thereto; and a light chain constant region, e.g., as described herein, e.g., a kappa chain constant region comprising the sequence of SEQ ID NO: 39, or a sequence with at least 85%, 90%, 95%, or 99% sequence identity thereto. In some embodiments, the cell or population of cells further comprises an IgJ heavy chain constant region or a fragment thereof. In some embodiments, the IgJ heavy chain constant region comprises the sequence of SEQ ID NO: 76 or a sequence with at least 85%, 90%, 95%, or 99% sequence identity thereto. In some embodiments, the IgJ is comprised in, e.g., expressed in, the same cell or population of cells comprising, e.g., expressing, the anti-TCRβV antibody molecule, e.g., the heavy chain and/or the light chain of the anti-TCRβV antibody molecule. In some embodiments, the IgJ is expressed in a different cell or population of cells than the cell or population of cells comprising, e.g., expressing, the anti-TCRβV antibody molecule, e.g., the heavy chain and/or the light chain of the anti-TCRβV antibody molecule.

In one aspect, the disclosure provides a cell, e.g., host cell, e.g., a population of cells, comprising a nucleic acid molecule encoding a multispecific molecule disclosed herein, or a nucleotide sequence having at least 75%, 80%, 85%, 90%, 95%, or 99% identity thereto.

In one aspect, disclosed herein is an anti-TCRβV antibody molecule for use in the manufacture of a medicament for treating a disease, e.g., cancer, in a subject.

In one aspect, disclosed herein is a multispecific molecule comprising an anti-TCRβV antibody molecule for use in the manufacture of a medicament for treating a disease, e.g., cancer, in a subject.

In another aspect, the disclosure provides a method of making, e.g., producing, an anti-TCRβV antibody molecule, a multispecific molecule described herein, comprising culturing a host cell described herein, under suitable conditions. In some embodiments of a method of making a multispecific molecule, the conditions comprise, e.g., conditions suitable for gene expression and/or homo- or heterodimerization.

In another aspect, the disclosure provides a pharmaceutical composition comprising an anti-TCRβV antibody molecule, or a multispecific molecule described herein, and a pharmaceutically acceptable carrier, excipient, or stabilizer.

In an aspect, the disclosure provides a method of modulating, e.g., enhancing, an immune response in a subject comprising administering to the subject an effective amount of an antibody molecule which binds (e.g., specifically binds) to a T cell receptor beta variable region (TCRβV) ("anti-TCRβV antibody molecule").

In an aspect, the disclosure provides a method of modulating, e.g., enhancing, an immune response in a subject comprising administering to the subject an effective amount of a multispecific molecule disclosed herein.

In some embodiments, the method comprises expanding, e.g., increasing the number of, an immune cell population in the subject.

In an aspect, the disclosure provides a method of expanding, e.g., increasing the number of, an immune cell population comprising, contacting the immune cell population with an effective amount of an antibody molecule which binds (e.g., specifically binds) to a T cell receptor beta variable region (TCRβV) ("anti-TCRβV antibody molecule").

In an aspect, the disclosure provides a method of expanding, e.g., increasing the number of, an immune cell population comprising, contacting the immune cell population with an effective amount of a multispecific molecule disclosed herein.

In some embodiments, the expansion occurs in vivo or ex vivo (e.g., in vitro).

In some embodiments, the immune cell population comprises a TCRβV expressing cell, e.g., a TCRβV+ cell.

In some embodiments, the TCRβV expressing cell is a T cell, e.g., a CD8+ T cell, a CD3+ T cell or a CD4+ T cell.

In some embodiments, the immune cell population comprises a T cell (e.g., a CD4 T cell, a CD8 T cell, (e.g., an effector T cell or a memory T cell (e.g., a memory effector T cell (e.g., TEM cell, e.g., TEMRA cell), or a tumor infiltrating lymphocyte (TIL).

In some embodiments, the immune cell population comprises a T cell, a Natural Killer cell, a B cell, or a myeloid cell.

In some embodiments, the immune cell population is obtained from a healthy subject.

In an aspect, provided herein is a method of treating a disease e.g., cancer, in a subject comprising administering to the subject an effective amount, e.g., a therapeutically effective amount, of an anti-TCRβV antibody molecule or a multispecific molecule comprising an anti-TCRβV antibody molecule disclosed herein, thereby treating the disease.

In a related aspect, provided herein is a composition comprising an anti-TCRβV antibody molecule or a multispecific molecule comprising an anti-TCRβV antibody molecule disclosed herein, for use in the treatment of a disease, e.g., cancer, in a subject.

In some embodiments, the disease is a cancer, e.g., a solid tumor or a hematological cancer, or a metastatic lesion.

In some embodiments, the method further comprises administering a second agent, e.g., therapeutic agent, e.g., as described herein. In some embodiments, second agent comprises a therapeutic agent (e.g., a chemotherapeutic agent, a biologic agent, hormonal therapy), radiation, or surgery. In some embodiments, therapeutic agent is selected from: a chemotherapeutic agent, or a biologic agent.

In another aspect, provided herein is a method of targeting, e.g., directing or re-directing, a therapy, e.g., treatment, to a T cell, e.g., in a subject, e.g., having a disease, e.g., cancer, comprising administering an effective amount of: (i) an anti-TCRβV antibody disclosed herein; and (ii) the therapy, e.g., a tumor targeting therapy (e.g., an antibody that binds to a cancer antigen), e.g., as described herein, thereby targeting the T cell.

In some embodiments, (i) and (ii) are conjugated, e.g., linked.

In some embodiments, (i) and (ii) are administered simultaneously or concurrently.

In some embodiments, the method results in: reduced cytokine release syndrome (CRS) (e.g., lesser duration of CRS or no CRS), or a reduced severity of CRS (e.g., absence of severe CRS, e.g., CRS grade 4 or 5) compared to administration of (ii) alone. In some embodiments, CRS is assessed by an assay of Example 3. In some embodiments, the method results in: reduced neurotoxicity (NT) (e.g., lesser duration of NT or no NT), or a reduced severity of NT (e.g., absence of severe NT) compared to administration of (ii) alone.

In yet another aspect, the disclosure provides, a method of targeting a T cell, e.g., in a subject having a disease, e.g., cancer, with an anti-TCRβV antibody disclosed herein or a multispecific molecule comprising an anti-TCRβV antibody disclosed herein.

In another aspect, the disclosure provides a method of treating, e.g., preventing or reducing, cytokine release syndrome (CRS) and/or neurotoxicity (NT) in a subject, e.g., CRS and/or NT associated with a treatment, e.g., a previously administered treatment, comprising administering to the subject an effective amount of an anti-TCRβV antibody disclosed herein or a multispecific molecule comprising an anti-TCRβV antibody disclosed herein, wherein, the subject has a disease, e.g., a cancer, thereby treating, e.g., preventing or reducing, CRS and/or NT in the subject.

In a related aspect, the disclosure provides a composition comprising an anti-TCRβV antibody disclosed herein or a multispecific molecule comprising an anti-TCRβV antibody disclosed herein, for use in the treatment, e.g., prevention or reduction, of cytokine release syndrome (CRS) and/or neurotoxicity (NT) in a subject, e.g., CRS and/or NT associated with a treatment, e.g., a previously administered treatment, comprising administering to the subject an effective amount of the anti-TCRβV antibody, wherein the subject has a disease, e.g., a cancer.

In some embodiments of a method or composition for use disclosed herein, the anti-TCRβV antibody is administered concurrently with or after the administration of the treatment associated with CRS and/or NT.

In another aspect, provided herein is a method of expanding, e.g., increasing the number of, an immune cell population comprising, contacting the immune cell population with an antibody molecule, e.g., humanized antibody molecule, which binds, e.g., specifically binds, to a T cell receptor beta variable chain (TCRβV) region (e.g., anti-TCRβV antibody molecule described herein or a multispecific molecule comprising an anti-TCRβV antibody molecule described herein), thereby expanding the immune cell population.

In some embodiments, the expansion occurs in vivo or ex vivo (e.g., in vitro).

In an aspect, provided herein is a method of evaluating a subject having a cancer, comprising acquiring a value of the status of a TCRβV molecule for the subject, wherein said value comprises a measure of the presence of, e.g., level or activity of, a TCRβV molecule in a sample from the subject, wherein the value of the status of a TCRβV molecule is higher, e.g., increased, in a sample from the subject compared to a reference value, e.g., a value from a healthy subject, e.g., a subject that does not have cancer.

In another aspect, the disclosure provides a method of treating a subject having a cancer, the method comprising (i) acquiring a value of the status of a TCRβV molecule for the subject, wherein said value comprises a measure of the presence of, e.g., level or activity of, a TCRβV molecule in a sample from the subject, and (ii) responsive to said value, administering an effective amount of an anti-TCRβV antibody molecule described herein (e.g., a TCRβV agonist) to the subject, thereby treating the cancer.

In some embodiments, the value is higher, e.g., increased, in a sample from the subject compared to a reference value, e.g., a value from a healthy subject, e.g., a subject that does not have cancer.

In a related aspect, the disclosure provides a composition comprising an anti-TCRβV antibody molecule for use in the treatment of a subject having a cancer, comprising (i) acquiring a value of the status of a TCRβV molecule for the subject, wherein said value comprises a measure of the presence of, e.g., level or activity of, a TCRβV molecule in a sample from the subject, and (ii) responsive to said value, administering an effective amount of an anti-TCRβV antibody molecule described herein (e.g., a TCRβV agonist) to the subject.

In an aspect, provided herein is method of evaluating a subject for the presence of a cancer, the method comprising:

(i) acquiring a value of the status of one or more TCRβV molecules for the subject, e.g., in a biological sample from the subject, wherein said value comprises a measure of the presence of, e.g., level or activity of, a TCRβV molecule in a sample from the subject, and (ii) determining whether the value for the one or more TCRβV molecules is higher, e.g., increased, in a sample from the subject compared to a reference value, e.g., a value from a healthy subject, e.g., a subject that does not have cancer, wherein a value that is higher, e.g., increased, in the subject relative to the reference, e.g., healthy subject, is indicative of the presence of cancer in the subject.

In another aspect, the disclosure provides, a method of treating a subject having cancer, the method comprising:

(i) acquiring a value of the status of one or more TCRβV molecules for the subject, e.g., in a biological sample from the subject, wherein said value comprises a measure of the presence of, e.g., level or activity of, a TCRβV molecule in a sample from the subject;

(ii) determining whether the value for the one or more TCRβV molecules is higher, e.g., increased, in a sample from the subject compared to a reference value, e.g., a value from a healthy subject, e.g., a subject that does not have cancer, and (iii) if a value that is higher, e.g., increased, in the subject relative to the reference value is determined, administering an effective amount of an anti-TCRβV antibody molecule, e.g., as described herein (e.g., a TCRβV agonist), to the subject, thereby treating the cancer.

In a related aspect, provided herein is a composition comprising anti-TCRβV antibody molecule for use in a method of treating a subject having a cancer, comprising (i) acquiring a value of the status of one or more TCRβV molecules for the subject, e.g., in a biological sample from the subject, wherein said value comprises a measure of the presence of, e.g., level or activity of, a TCRβV molecule in a sample from the subject;

(ii) determining whether the value for the one or more TCRβV molecules is higher, e.g., increased, in a sample from the subject compared to a reference value, e.g., a value from a healthy subject, e.g., a subject that does not have cancer, and (iii) if a value that is higher, e.g., increased, in the subject relative to the reference value is determined, administering an effective amount of an anti-TCRβV antibody molecule, e.g., as described herein (e.g., a TCRβV agonist), to the subject.

In some embodiments of any of the methods of treatment, or composition for use disclosed herein, the status is indicative of the subject having cancer, or a symptom thereof.

In some embodiments of any of the methods of treatment or composition for use disclosed herein, the status is indicative of responsiveness to a therapy, e.g., a therapy comprising an anti-TCRβV antibody molecule, e.g., as described herein.

In some embodiments of any of the methods of treatment or composition for use disclosed herein, the value of the status is determined, e.g., measured, by an assay described herein.

In yet another aspect, provided herein is a method of treating a subject having a cancer, comprising administering to the subject an effective amount of an anti-TCRBV antibody molecule described herein, wherein the subject has a higher, e.g., increased, level or activity of one or more TCRBV molecules, e.g., as described herein, compared to a reference level or activity of one or more TCRBV molecules, e.g., in a healthy subject, e.g., a subject not having a cancer In an aspect, the disclosure provides, method of treating a subject having a cancer, comprising
- (i) isolating a biological sample from the subject; e.g., a peripheral blood sample, biopsy sample, or bone marrow sample; and
- (ii) acquiring a value of the status of one or more TCRβV molecules for the subject, e.g., in the biological sample from the subject, wherein said value comprises a measure of the presence of, e.g., level or activity of, a TCRβV molecule in a sample from the subject compared to a reference value, e.g., a sample from a health subject, wherein a value that is higher, e.g., increased, in the subject relative to the reference, e.g., healthy subject, is indicative of the presence of cancer in the subject,
- (iii) contacting the biological sample with an anti-TCRβV antibody molecule, e.g., in vitro; and
- (iv) administering the biological sample or a portion thereof from step (iii) to the subject.

In another aspect, provided herein is method of expanding a population of immune effector cells from a subject having a cancer, the method comprising:
- (i) isolating a biological sample comprising a population of immune effector cells from the subject; e.g., a peripheral blood sample, biopsy sample, or bone marrow sample;
- (ii) acquiring a value of the status of one or more TCRβV molecules for the subject, e.g., in the biological sample from the subject, wherein said value comprises a measure of the presence of, e.g., level or activity of, a TCRβV molecule in a sample from the subject compared to a reference value, e.g., a sample from a health subject, wherein a value that is higher, e.g., increased, in the subject relative to the reference, e.g., healthy subject, is indicative of the presence of cancer in the subject, and
- (iii) contacting the biological sample comprising a population of immune effector cells with an anti-TCRβV antibody molecule.

In some embodiments, the method further comprises administering the population of immune effector cells contacted with the anti-TCRβV antibody molecule to the subject.

In some embodiments, a method of expansion, or method of treatment, or composition for use disclosed herein comprises measuring T cell function (e.g., cytotoxic activity, cytokine secretion, or degranulation) in the population of immune effector cells, e.g., compared to a reference population, e.g., an otherwise similar population not contacted with the anti-TCRβV antibody molecule or a population of immune effector cells obtained from a healthy subject (e.g., a subject that does not have a cancer).

In some embodiments of any of the methods or composition for use disclosed herein, the biological sample comprising the population of immune effector cells is contacted with an anti-TCRβV antibody molecule that binds to the one or more TCRβV molecules (e.g., the same TCRβV molecule) identified as being higher, e.g., increased, in the biological sample.

In some embodiments of any of the methods or composition for use disclosed herein, the biological sample comprising the population of immune effector cells is contacted with an anti-TCRβV antibody molecule that does not bind to the one or more TCRβV molecules (e.g., a different TCRβV molecule) identified as being higher, e.g., increased, in the biological sample.

In another aspect, provided herein is a method of identifying one or more TCRβV molecules associated with a cancer, the method comprising:
- (i) acquiring a status for a plurality of TCRβV molecules in a biological sample from a first subject having the disease and in a biological sample from a second subject not having the disease; and
- (ii) determining whether the level or activity of one or more of the TCRβV molecules is higher, e.g., increased, in the first subject relative to the second subject;

thereby identifying one or more TCRβV molecules associated with the cancer.

In some embodiments of any of the methods or composition for use disclosed herein, the one or more of the TCRβV molecules comprises one or more, (e.g., all) of the following TCRβV subfamilies:
- (i) TCRβ V6 subfamily comprising, e.g., one or more of TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01;
- (ii) TCRβ V10 subfamily comprising, e.g., one or more of TCRβ V10-101, TCRβ V10-1*02, TCRβ V10-3*01 or TCRβ V10-2*01;
- (iii) TCRβ V5 subfamily comprising, e.g., one or more of TCRβ V5-6*01, TCRβ V5-4*01, or TCRβ V5-8*01;
- (iv) TCRβ V12 subfamily comprising e.g., one or more of TCRβ V12-4*01, TCRβ V12-3*01, or TCRβ V12-5*01;
- (v) TCRβ V7 subfamily comprising e.g., one or more of TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01;
- (vi) TCRβ V11 subfamily comprising e.g., one or more of TCRβ V11-1*01, TCRβ V11-2*01 or TCRβ V11-3*01;
- (vii) TCRβ V14 subfamily comprising TCRβ V14*01;
- (viii) TCRβ V16 subfamily comprising TCRβ V16*01;
- (ix) TCRβ V18 subfamily comprising TCRβ V18*01;
- (x) TCRβ V9 subfamily comprising T e.g., one or more of CRβ V9*01 or TCRβ V9*02;
- (xi) TCRβ V13 subfamily comprising TCRβ V13*01;
- (xii) TCRβ V4 subfamily comprising e.g., one or more of e.g., one or more of TCRβ V4-2*01, TCRβ V4-3*01, or TCRβ V4-1*01;
- (xiii) TCRβ V3 subfamily comprising TCRβ V3-1*01;
- (xiv) TCRβ V2 subfamily comprising TCRβ V2*01;
- (xv) TCRβ V15 subfamily comprising TCRβ V 15*01;
- (xvi) TCRβ V30 subfamily comprising e.g., one or more of TCRβ V30*01, or TCRβV30*02;
- (xvii) TCRβ V19 subfamily comprising e.g., one or more of TCRβ V19*01, or TCRβV19*02;
- (xviii) TCRβ V27 subfamily comprising TCRβ V27*01;
- (xix) TCRβ V28 subfamily comprising TCRβ V28*01;
- (xx) TCRβ V24 subfamily comprising TCRβ V24-1*01;
- (xxi) TCRβ V20 subfamily comprising e.g., one or more of TCRβ V20-1*01, or TCRβV20-1*02;
- (xxii) TCRβ V25 subfamily comprising TCRβ V25-1*01; or
- (xxiii) TCRβ V29 subfamily comprising TCRβ V29-1*01;
- (xxiv) TCRβ V21 subfamily;

(xxv) TCRβ V1 subfamily;
(xxvi) TCRβ V17 subfamily;
(xvii) TCRβ V23 subfamily; or
(xviii) TCRβ V26 subfamily.

In some embodiments of any of the methods or composition for use disclosed herein, the cancer is a solid tumor including but not limited to: melanoma, pancreatic (e.g., pancreatic adenocarcinoma) cancer, breast cancer, colorectal cancer (CRC), lung cancer (e.g., small or non-small cell lung cancer), skin cancer, ovarian cancer, or liver cancer.

In some embodiments of any of the methods or composition for use disclosed herein, the cancer is a hematological cancer including, but not limited to: a B-cell or T cell malignancy, e.g., Hodgkin's lymphoma, Non-Hodgkin's lymphoma (e.g., B cell lymphoma, diffuse large B cell lymphoma (DLBCL), follicular lymphoma, chronic lymphocytic leukemia (B-CLL), mantle cell lymphoma, marginal zone B-cell lymphoma, Burkitt lymphoma, lymphoplasmacytic lymphoma, hairy cell leukemia), acute myeloid leukemia (AML), chronic myeloid leukemia, myelodysplastic syndrome, multiple myeloma, and acute lymphocytic leukemia.

In some embodiments of a method of expansion, or method of treatment, or composition for use disclosed herein, a higher, e.g., increased, level or activity of one or more TCRβV molecules in a subject, e.g., in a sample from a subject, is indicative of a bias, e.g., a preferential expansion, e.g., clonal expansion, of T cells expressing said one or more TCRβV molecules in the subject.

In some embodiments, a subject having a cancer, e.g., as disclosed herein, has a higher, e.g., increased, level or activity of one or more TCRβV molecules associated with the cancer. In some embodiments, the TCRβV molecule is associated with, e.g., recognizes, a cancer antigen, e.g., a cancer associated antigen or a neoantigen.

In some embodiments of any of the methods or composition for use disclosed herein, the subject has B-CLL. In some embodiments, a subject having B-CLL has a higher, e.g., increased, level or activity of one or more TCRβV molecules, e.g., one or more TCRβV molecules comprising: (i) TCRβ V6 subfamily comprising, e.g., TCRβ V6-4*01, TCRβ V6-4*02, TCRβV6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01; (ii) TCRβ V5 subfamily comprising TCRβ V5-6*01, TCRβV5-4*01, or TCRβ V5-8*01; (iii) TCRβ V3 subfamily comprising TCRβ V3-1*01; (iv) TCRβV2 subfamily comprising TCRβ V2*01; or (v) TCRβ V19 subfamily comprising TCRβ V19*01, or TCRβ V19*02.

In some embodiments, a subject having B-CLL has a higher, e.g., increased, level or activity of a TCRβ V6 subfamily comprising, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβV6-3*01 or TCRβ V6-1*01. In some embodiments, the subject is administered an anti-TCRβV molecule (e.g., an agonistic anti-TCRβV molecule as described herein) that binds to one or more members of the TCRβ V6 subfamily. In some embodiments, administration of the an anti-TCRβV molecule results in expansion of immune cells expressing one or more members of the TCRβ V6 subfamily.

In some embodiments, a subject having B-CLL has a higher, e.g., increased, level or activity of a TCRβ V5 subfamily comprising TCRβ V5-6*01, TCRβ V5-4*01, or TCRβ V5-8*01. In some embodiments, the subject is administered an anti-TCRβV molecule (e.g., an agonistic anti-TCRβV molecule as described herein) that binds to one or more members of the TCRβ V5 subfamily. In some embodiments, administration of the an anti-TCRβV molecule results in expansion of immune cells expressing one or more members of the TCRβ V5 subfamily.

In some embodiments, a subject having B-CLL has a higher, e.g., increased, level or activity of a TCRβ V3 subfamily comprising TCRβ V3-1*01. In some embodiments, the subject is administered an anti-TCRβV molecule (e.g., an agonistic anti-TCRβV molecule as described herein) that binds to one or more members of the TCRβ V3 subfamily. In some embodiments, administration of the an anti-TCRβV molecule results in expansion of immune cells expressing one or more members of the TCRβ V3 subfamily.

In some embodiments, a subject having B-CLL has a higher, e.g., increased, level or activity of a TCRβ V2 subfamily comprising TCRβ V2*01. In some embodiments, the subject is administered an anti-TCRβV molecule (e.g., an agonistic anti-TCRβV molecule as described herein) that binds to one or more members of the TCRβ V2 subfamily. In some embodiments, administration of the an anti-TCRβV molecule results in expansion of immune cells expressing one or more members of the TCRβ V2 subfamily.

In some embodiments, a subject having B-CLL has a higher, e.g., increased, level or activity of a TCRβ V19 subfamily comprising TCRβ V19*01, or TCRβ V19*02. In some embodiments, the subject is administered an anti-TCRβV molecule (e.g., an agonistic anti-TCRBV molecule as described herein) that binds to one or more members of the TCRβ V19 subfamily. In some embodiments, administration of the an anti-TCRβV molecule results in expansion of immune cells expressing one or more members of the TCRβ V19 subfamily.

In some embodiments of any of the methods or composition for use disclosed herein, the subject has melanoma. In some embodiments, a subject having melanoma has a higher, e.g., increased, level or activity of one or more TCRβV molecules, e.g., one or more TCRβV molecules comprising the TCRβ V6 subfamily comprising, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, the subject is administered an anti-TCRβV molecule (e.g., an agonistic anti-TCRβV molecule as described herein) that binds to one or more members of the TCRβ V6 subfamily. In some embodiments, administration of the an anti-TCRβV molecule results in expansion of immune cells expressing one or more members of the TCRβ V6 subfamily.

In some embodiments of any of the methods or composition for use disclosed herein, the subject has DLBCL. In some embodiments, a subject having melanoma has a higher, e.g., increased, level or activity of one or more TCRβV molecules, e.g., one or more TCRβV molecules comprising: (i) TCRβ V13 subfamily comprising TCRβ V13*01; (ii) TCRβ V3 subfamily comprising TCRβ V3-1*01; or (iii) TCRβ V23 subfamily.

In some embodiments, a subject having DLBCL has a higher, e.g., increased, level or activity of a TCRβ V13 subfamily comprising TCRβ V13*01. In some embodiments, the subject is administered an anti-TCRβV molecule (e.g., an agonistic anti-TCRβV molecule as described herein) that binds to one or more members of the TCRβ V13 subfamily. In some embodiments, administration of the an anti-TCRβV molecule results in expansion of immune cells expressing one or more members of the TCRβ V13 subfamily.

In some embodiments, a subject having DLBCL has a higher, e.g., increased, level or activity of a TCRβ V3 subfamily comprising TCRβ V3-1*01. In some embodiments, the subject is administered an anti-TCRβV molecule (e.g., an agonistic anti-TCRβV molecule as described herein) that binds to one or more members of the TCRβ V3 subfamily. In some embodiments, administration of the an anti-TCRβV molecule results in expansion of immune cells expressing one or more members of the TCRβ V3 subfamily.

In some embodiments, a subject having DLBCL has a higher, e.g., increased, level or activity of a TCRβ V23 subfamily. In some embodiments, the subject is administered an anti-TCRβV molecule (e.g., an agonistic anti-TCRβV molecule as described herein) that binds to one or more members of the TCRβ V23 subfamily. In some embodiments, administration of the an anti-TCRβV molecule results in expansion of immune cells expressing one or more members of the TCRβ V23 subfamily.

In some embodiments of any of the methods or composition for use disclosed herein, the subject has CRC. In some embodiments, a subject having melanoma has a higher, e.g., increased, level or activity of one or more TCRβV molecules, e.g., one or more TCRβV molecules comprising: (i) TCRβ V19 subfamily comprising TCRβ V19*01, or TCRβ V19*02; (ii) TCRβ V12 subfamily comprising TCRβ V 12-4*01, TCRβ V 12-3*01, or TCRβ V 12-5*01; (iii) TCRβ V16 subfamily comprising TCRβ V16*01; or (iv) TCRβ V21 subfamily.

In some embodiments, a subject having CRC has a higher, e.g., increased, level or activity of a TCRβ V19 subfamily comprising TCRβ V19*01, or TCRβ V19*02. In some embodiments, the subject is administered an anti-TCRβV molecule (e.g., an agonistic anti-TCRβV molecule as described herein) that binds to one or more members of the TCRβ V19 subfamily. In some embodiments, administration of the an anti-TCRβV molecule results in expansion of immune cells expressing one or more members of the TCRβ V19 subfamily.

In some embodiments, a subject having CRC has a higher, e.g., increased, level or activity of a TCRβ V12 subfamily comprising TCRβ V12-4*01, TCRβ V12-3*01, or TCRβV12-5*01. In some embodiments, the subject is administered an anti-TCRβV molecule (e.g., an agonistic anti-TCRβV molecule as described herein) that binds to one or more members of the TCRβ V12 subfamily. In some embodiments, administration of the an anti-TCRβV molecule results in expansion of immune cells expressing one or more members of the TCRβ V12 subfamily.

In some embodiments, a subject having CRC has a higher, e.g., increased, level or activity of a TCRβ V16 subfamily comprising TCRβ V16*01. In some embodiments, the subject is administered an anti-TCRβV molecule (e.g., an agonistic anti-TCRβV molecule as described herein) that binds to one or more members of the TCRβ V16 subfamily. In some embodiments, administration of the an anti-TCRβV molecule results in expansion of immune cells expressing one or more members of the TCRβ V16 subfamily.

In some embodiments, a subject having CRC has a higher, e.g., increased, level or activity of a TCRβ V21 subfamily. In some embodiments, the subject is administered an anti-TCRβV molecule (e.g., an agonistic anti-TCRβV molecule as described herein) that binds to one or more members of the TCRβ V21 subfamily. In some embodiments, administration of the an anti-TCRβV molecule results in expansion of immune cells expressing one or more members of the TCRβ V21 subfamily.

Alternatively or in combination with any of the embodiments disclosed herein, provided herein is an anti-TCRβV antibody molecule which:
  (i) binds specifically to an epitope on TCRβV, e.g., the same or similar epitope as the epitope recognized by an anti-TCRβV antibody molecule as described herein, e.g., a second anti-TCRβV antibody molecule;
  (ii) shows the same or similar binding affinity or specificity, or both, as an anti-TCRβV antibody molecule as described herein, e.g., a second anti-TCRβV antibody molecule;
  (iii) inhibits, e.g., competitively inhibits, the binding of an anti-TCRβV antibody molecule as described herein, e.g., a second anti-TCRβV antibody molecule;
  (iv) binds the same or an overlapping epitope with an anti-TCRβV antibody molecule as described herein, e.g., a second anti-TCRβV antibody molecule; or
  (v) competes for binding, and/or binds the same epitope, with an anti-TCRβV antibody molecule as described herein, e.g., a second anti-TCRβV antibody molecule, In some embodiments, the second anti-TCRβV antibody molecule comprises an antigen binding domain chosen from Table 1 or Table 2, or a sequence substantially identical thereto. In some embodiments, the second anti-TCRβV antibody molecule comprises an antigen binding domain, comprising:
  a heavy chain complementarity determining region 1 (HC CDR1), a heavy chain complementarity determining region 2 (HC CDR2) and/or a heavy chain complementarity determining region 3 (HC CDR3) of SEQ ID NO: 1 or SEQ ID NO: 9; and/or a light chain complementarity determining region 1 (LC CDR1), a light chain complementarity determining region 2 (LC CDR2), and/or a light chain complementarity determining region 3 (LC CDR3) of SEQ ID NO: 2, SEQ ID NO: 10 or SEQ ID NO: 11.

In some embodiments of any of the compositions or methods disclosed herein, the anti-TCRβV antibody molecule comprises an antigen binding domain comprising:
  (i) a heavy chain complementarity determining region 1 (HC CDR1), a heavy chain complementarity determining region 2 (HC CDR2) and/or a heavy chain complementarity determining region 3 (HC CDR3) of SEQ ID NO: 1 or SEQ ID NO: 9, or a sequence disclosed in Table 1; or
  (ii) a light chain complementarity determining region 1 (LC CDR1), a light chain complementarity determining region 2 (LC CDR2), and/or a light chain complementarity determining region 3 (LC CDR3) of SEQ ID NO: 2, SEQ ID NO: 10 or SEQ ID NO: 11, or a sequence disclosed in Table 1.

In some embodiments of any of the compositions or methods disclosed herein, the anti-TCRβV antibody molecule comprises an antigen binding domain comprising a light chain variable region (VL) comprising one, two or all (e.g., three) of a LC CDR1, a LC CDR2 and a LC CDR3 of SEQ ID NO: 2, SEQ ID NO: 10 or SEQ ID NO: 11.

In some embodiments of any of the compositions or methods disclosed herein, the anti-TCRβV antibody molecule comprises an antigen binding domain comprising a heavy chain variable region (VH) comprising one, two or all (e.g., three) of a HC CDR1, a HC CDR2 and a HC CDR3 of SEQ ID NO:1 or SEQ ID NO: 9.

In some embodiments of any of the compositions or methods disclosed herein, the anti-TCRβV antibody molecule comprises an antigen binding domain comprising:

(i) a VL comprising: a LC CDR1 amino acid sequence of SEQ ID NO: 6 (or an amino acid sequence with not more than 1, 2, 3 or 4 modifications, e.g., substitutions, additions or deletions thereof), a LC CDR2 amino acid sequence of SEQ ID NO:7 (or an amino acid sequence with not more than 1, 2, 3 or 4 modifications, e.g., substitutions, additions or deletions thereof), and/or a LC CDR3 amino acid sequence of SEQ ID NO:8 (or an amino acid sequence with not more than 1, 2, 3 or 4 modifications, e.g., substitutions, additions or deletions thereof); and/or (ii) a VH comprising: a HC CDR1 amino acid sequence of SEQ ID NO: 3 (or an amino acid sequence with not more than 1, 2, 3 or 4 modifications, e.g., substitutions, additions or deletions thereof), a HC CDR2 amino acid sequence of SEQ ID NO:4 (or an amino acid sequence with not more than 1, 2, 3 or 4 modifications, e.g., substitutions, additions or deletions thereof), and/or a HC CDR3 amino acid sequence of SEQ ID NO:5 (or an amino acid sequence with not more than 1, 2, 3 or 4 modifications, e.g., substitutions, additions or deletions thereof).

In some embodiments of any of the compositions or methods disclosed herein, the anti-TCRβV antibody molecule comprises an antigen binding domain comprising:
  a variable heavy chain (VH) of SEQ ID NO: 9, or a sequence having at least about 75%, 80%, 85%, 90%, 95%, or 99% sequence identity thereto; and/or
  a variable light chain (VL) of SEQ ID NO: 10 or SEQ ID NO: 11, or a sequence having at least about 75%, 80%, 85%, 90%, 95%, or 99% sequence identity thereto.

In some embodiments of any of the compositions or methods disclosed herein, the anti-TCRβV antibody molecule comprises an antigen binding domain comprising the VH amino acid sequence of SEQ ID NO: 9 and the VL amino acid sequence of SEQ ID NO: 10.

In some embodiments of any of the compositions or methods disclosed herein, the anti-TCRβV antibody molecule comprises an antigen binding domain comprising the VH amino acid sequence of SEQ ID NO: 9 and the VL amino acid sequence of SEQ ID NO: 11.

In some embodiments of any of the compositions or methods disclosed herein, the anti-TCRβV antibody molecule comprises a heavy chain comprising a framework region, e.g., framework region 3 (FR3), comprising one or both of: (i) a Threonine at position 73, e.g., a substitution at position 73 according to Kabat numbering, e.g., a Glutamic Acid to Threonine substitution; or (ii) a Glycine at position, e.g., a substitution at position 94 according to Kabat numbering, e.g., a Arginine to Glycine substitution. In some embodiments, the substitution is relative to a human germline heavy chain framework region sequence.

In some embodiments of any of the compositions or methods disclosed herein, the anti-TCRβV antibody molecule comprises a light chain comprising a framework region, e.g., framework region 1 (FR1), comprising a Phenylalanine at position 10, e.g., a substitution at position 10 according to Kabat numbering, e.g., a Serine to Phenylalanine substitution. In some embodiments, the substitution is relative to a human germline light chain framework region sequence.

In some embodiments of any of the compositions or methods disclosed herein, the anti-TCRβV antibody molecule comprises a light chain comprising a framework region, e.g., framework region 2 (FR2), comprising one or both of: (i) a Histidine at position 36, e.g., a substitution at position 36 according to Kabat numbering, e.g., a Tyrosine to Histidine substitution; or (ii) an Alanine at position 46, e.g., a substitution at position 46 according to Kabat numbering, e.g., a Arginine to Alanine substitution. In some embodiments, the substitution is relative to a human germline light chain framework region sequence.

In some embodiments of any of the compositions or methods disclosed herein, the anti-TCRβV antibody molecule comprises a light chain comprising a framework region, e.g., framework region 3 (FR3), comprising a Phenylalanine at position 87, e.g., a substitution at position 87 according to Kabat numbering, e.g., a Tyrosine to Phenylalanine substitution. In some embodiments, the substitution is relative to a human germline light chain framework region sequence.

In some embodiments of any of the compositions or methods disclosed herein, the anti-TCRβV antibody molecule binds to TCRβ V6, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβV6-3*01 or TCRβ V6-1*01. In some embodiments the anti-TCRβV antibody molecule binds to TCRβ V6-5*01.

In some embodiments, TCRβ V6, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01, is recognized, e.g., bound, by SEQ ID NO: 1 and/or SEQ ID NO: 2. In some embodiments, TCRβ V6, e.g., TCRβ V6-4*01, TCRβ V6-4*02, TCRβ V6-9*01, TCRβV6-8*01, TCRβ V6-5*01, TCRβ V6-6*02, TCRβ V6-6*01, TCRβ V6-2*01, TCRβ V6-3*01 or TCRβ V6-1*01, is recognized, e.g., bound, by SEQ ID NO: 9 and/or SEQ ID NO: 10. In some embodiments, TCRβ V6, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01, is recognized, e.g., bound, by SEQ ID NO: 9 and/or SEQ ID NO: 11. In some embodiments, TCRβ V6-5*01 is recognized, e.g., bound by SEQ ID NO: 9 and/or SEQ ID NO: 10, or a sequence having at least about 75%, 80%, 85%, 90%, 95%, or 99% sequence identity thereto. In some embodiments, TCRβ V6-5*01 is recognized, e.g., bound by SEQ ID NO: 9 and/or SEQ ID NO: 11, or a sequence having at least about 75%, 80%, 85%, 90%, 95%, or 99% sequence identity thereto.

In some embodiments of any of the compositions or methods disclosed herein, the anti-TCRβV antibody molecule comprises an antigen binding domain comprising:
  (i) a heavy chain complementarity determining region (HC CDR1), a HC CDR2 and/or a HC CDR3 of SEQ ID NO: 15, SEQ ID NO: 23, SEQ ID NO: 24 or SEQ IC NO: 25, or a sequence disclosed in Table 2; and/or
  (ii) a light chain complementarity determining region 1 (LC CDR1), a LC CDR2, and/or a LC CDR3 of SEQ ID NO: 16, SEQ ID NO: 26, SEQ ID NO: 27, SEQ ID NO: 28, SEQ ID NO: 29 or SEQ ID NO:30, or a sequence disclosed in Table 2.

In some embodiments of any of the compositions or methods disclosed herein, the anti-TCRβV antibody molecule comprises an antigen binding domain comprising a light chain variable region (VL) comprising one, two or all of a LC CDR1, a LC CDR2 and a LC CDR3 of SEQ ID NO: 16, SEQ ID NO: 26, SEQ ID NO: 27, SEQ ID NO: 28, SEQ ID NO: 29 or SEQ ID NO:30.

In some embodiments of any of the compositions or methods disclosed herein, the anti-TCRβV antibody molecule comprises an antigen binding domain comprising a heavy chain variable region (VH) comprising one, two or all of a HC CDR1, a HC CDR2 and a HC CDR3 of SEQ ID NO: 15, SEQ ID NO: 23, SEQ ID NO: 24 or SEQ ID NO: 25.

In some embodiments of any of the compositions or methods disclosed herein, the anti-TCRβV antibody molecule comprises an antigen binding domain comprising:
(i) a VL comprising: a LC CDR1 amino acid sequence of SEQ ID NO: 20 (or an amino acid sequence with not more than 1, 2, 3 or 4 modifications, e.g., substitutions, additions or deletions thereof), a LC CDR2 amino acid sequence of SEQ ID NO:21 (or an amino acid sequence with not more than 1, 2, 3 or 4 modifications, e.g., substitutions, additions or deletions thereof), and/or a LC CDR3 amino acid sequence of SEQ ID NO:22 (or an amino acid sequence with not more than 1, 2, 3 or 4 modifications, e.g., substitutions, additions or deletions thereof); and/or
(ii) a VH comprising: a HC CDR1 amino acid sequence of SEQ ID NO: 17 (or an amino acid sequence with not more than 1, 2, 3 or 4 modifications, e.g., substitutions, additions or deletions thereof), a HC CDR2 amino acid sequence of SEQ ID NO:18 (or an amino acid sequence with not more than 1, 2, 3 or 4 modifications, e.g., substitutions, additions or deletions thereof), and/or a HC CDR3 amino acid sequence of SEQ ID NO:19 (or an amino acid sequence with not more than 1, 2, 3 or 4 modifications, e.g., substitutions, additions or deletions thereof).

In some embodiments of any of the compositions or methods disclosed herein, the anti-TCRβV antibody molecule comprises an antigen binding domain comprising:
a variable heavy chain (VH) of SEQ ID NO: 23, SEQ ID NO: 24 or SEQ ID NO: 25, or a sequence having at least about 75%, 80%, 85%, 90%, 95%, or 99% sequence identity thereto; and/or
a variable light chain (VL) of SEQ ID NO: 26, SEQ ID NO: 27, SEQ ID NO: 28, SEQ ID NO: 29 or SEQ ID NO:30, or a sequence having at least about 75%, 80%, 85%, 90%, 95%, or 99% sequence identity thereto.

In some embodiments of any of the compositions or methods disclosed herein, the anti-TCRβV antibody molecule comprises a light chain comprising a framework region, e.g., framework region 1 (FR1), comprising one, two or all (e.g., three) of: (i) an Aspartic Acid at position 1, e.g., a substitution at position 1 according to Kabat numbering, e.g., a Alanine to Aspartic Acid substitution; or (ii) an Asparagine at position 2, e.g., a substitution at position 2 according to Kabat numbering, e.g., a Isoleucine to Asparagine substitution, a Serine to Asparagine substitution, or a Tyrosine to Asparagine substitution; or (iii) a Leucine at position 4, e.g., a substitution at position 4 according to Kabat numbering, e.g., a Methionine to Leucine substitution. In some embodiments, the substitution is relative to a human germline light chain framework region sequence.

In some embodiments of any of the compositions or methods disclosed herein, the anti-TCRβV antibody molecule comprises a light chain comprising a framework region, e.g., framework region 3 (FR3), comprising one, two or all (e.g., three) of: (i) a Glycine as position 66, e.g., a substitution at position 66 according to Kabat numbering, e.g., a Lysine to Glycine substitution, or a Serine to Glycine substitution; or (ii) an Asparagine at position 69, e.g., a substitution at position 69 according to Kabat numbering, e.g., a Threonine to Asparagine substitution; or (iii) a Tyrosine at position 71, e.g., a substitution at position 71 according to Kabat numbering, e.g., a Phenylalanine to Tyrosine substitution, or an Alanine to Tyrosine substitution.

In some embodiments, the substitution is relative to a human germline light chain framework region sequence.

In some embodiments of any of the compositions or methods disclosed herein, the anti-TCRβV antibody molecule binds to TCRβ V12, e.g., TCRβ V12-4*01, TCRβ V12-3*01, or TCRβ V12-5*01. In some embodiments the anti-TCRβV antibody molecule binds to TCRβ V12-4*01 or TCRβ V12-3*01.

In some embodiments, TCRβ V12, e.g., TCRβ V12-4*01, TCRβ V12-3*01, or TCRβV12-5*01 is recognized, e.g., bound, by SEQ ID NO: 15 and/or SEQ ID NO: 16. In some embodiments, TCRβ V12, e.g., TCRβ V12-4*01, TCRβ V12-3*01, or TCRβ V12-5*01, is recognized, e.g., bound, by any one of SEQ ID NOs 23-25, and/or any one of SEQ ID NO: 26-30, or an amino acid sequence having at least about 75%, 80%, 85%, 90%, 95%, or 99% sequence identity thereto. In some embodiments TCRβ V12-4*01 is recognized, e.g., bound, by any one of SEQ ID NOs 23-25, and/or any one of SEQ ID NO: 26-30, or an amino acid sequence having at least about 75%, 80%, 85%, 90%, 95%, or 99% sequence identity thereto. In some embodiments TCRβ V12-3*01 is recognized, e.g., bound, by any one of SEQ ID NOs 23-25, and/or any one of SEQ ID NO: 26-30, or an amino acid sequence having at least about 75%, 80%, 85%, 90%, 95%, or 99% sequence identity thereto.

In some embodiments of any of the compositions or methods disclosed herein, the anti-TCRβV antibody molecule comprises the anti-TCRβV antibody molecule comprises an antigen binding domain comprising a single chain Fv (scFv) or a Fab.

In some embodiments of any of the compositions or methods disclosed herein, the anti-TCRβV antibody molecule comprises binds to a conformational or a linear epitope on the T cell.

In some embodiments of any of the compositions or methods disclosed herein, the tumor comprises an antigen, e.g., a tumor antigen, e.g., a tumor associated antigen or a neoantigen. In some embodiments, the anti-TCRβV antibody molecule recognize, e.g., bind to, the tumor antigen.

In some embodiments of any of the compositions or methods disclosed herein, the anti-TCRβV antibody molecule is a full antibody (e.g., an antibody that includes at least one, and preferably two, complete heavy chains, and at least one, and preferably two, complete light chains), or an antigen-binding fragment (e.g., a Fab, F(ab')$_2$, Fv, a single chain Fv fragment, a single domain antibody, a diabody (dAb), a bivalent antibody, or bispecific antibody or fragment thereof, a single domain variant thereof, a camelid antibody, or a rat-derived VH.

In some embodiments of any of the compositions or methods disclosed herein, the anti-TCRβV antibody molecule comprises the anti-TCRβV antibody molecule comprises one or more heavy chain constant regions chosen from IgG1, IgG2, IgG3, IgGA1, IgGA2, IgM, IgJ or IgG4, or a fragment thereof, e.g., as disclosed in Table 3.

In some embodiments of any of the compositions or methods disclosed herein, the anti-TCRβV antibody molecule comprises a heavy chain constant region of an IgM or a fragment thereof, optionally wherein the IgM heavy chain constant region comprises the sequence of SEQ ID NO: 73, or a sequence with at least 85%, 90%, 95%, or 99% sequence identity thereto. In some embodiments of any of the compositions or methods disclosed herein, the anti-TCRβV antibody molecule comprising an IgM constant region, further comprises a heavy chain constant region of an IgJ or a fragment thereof, optionally wherein the IgJ heavy chain constant region comprises the sequence of SEQ ID NO: 76 or a sequence with at least 85%, 90%, 95%, or 99% sequence identity thereto.

In some embodiments of any of the compositions or methods disclosed herein, the anti-TCRβV antibody molecule comprises a heavy chain constant region of an IgJ or a fragment thereof, optionally wherein the IgJ heavy chain constant region comprises the sequence of SEQ ID NO: 76 or a sequence with at least 85%, 90%, 95%, or 99% sequence identity thereto.

In some embodiments of any of the compositions or methods disclosed herein, the anti-TCRβV antibody molecule comprises a heavy chain constant region of an IgGA1, or a fragment thereof, optionally wherein the IgGA1 heavy chain constant region comprises the sequence of SEQ ID NO: 74, or a sequence with at least 85%, 90%, 95%, or 99% sequence identity thereto.

In some embodiments of any of the compositions or methods disclosed herein, the anti-TCRβV antibody molecule comprises a heavy chain constant region of an IgGA2, or a fragment thereof, optionally wherein the IgGA2 heavy chain constant region comprises a sequence listed in Table 3, e.g., SEQ ID NO: 75, or a sequence with at least 85%, 90%, 95%, or 99% sequence identity thereto.

In some embodiments of any of the compositions or methods disclosed herein, binding of the anti-TCRβV antibody molecule to a TCRβV region results in a cytokine profile, e.g., a cytokine secretion profile, (e.g., comprising one or more cytokines and/or one or more chemokines), that differs from that of a T cell engager that binds to a receptor or molecule other than a TCRβV region ("a non-TCRβV-binding T cell engager").

In some embodiments, the cytokine profile, e.g., cytokine secretion profile, comprises the level and/or activity of one or more cytokines and/or one or more chemokines (e.g., as described herein). In an embodiment, a cytokine profile, e.g., a cytokine secretion profile, comprises the level and/or activity of one or more of: IL-2 (e.g., full length, a variant, or a fragment thereof); IL-1beta (e.g., full length, a variant, or a fragment thereof); IL-6 (e.g., full length, a variant, or a fragment thereof); TNFα (e.g., full length, a variant, or a fragment thereof); IFNg (e.g., full length, a variant, or a fragment thereof) IL-10 (e.g., full length, a variant, or a fragment thereof); IL-4 (e.g., full length, a variant, or a fragment thereof); TNF alpha (e.g., full length, a variant, or a fragment thereof); IL-12p70 (e.g., full length, a variant, or a fragment thereof); IL-13 (e.g., full length, a variant, or a fragment thereof); IL-8 (e.g., full length, a variant, or a fragment thereof); Eotaxin (e.g., full length, a variant, or a fragment thereof); Eotaxin-3 (e.g., full length, a variant, or a fragment thereof); IL-8 (HA) (e.g., full length, a variant, or a fragment thereof); IP-10 (e.g., full length, a variant, or a fragment thereof); MCP-1 (e.g., full length, a variant, or a fragment thereof); MCP-4 (e.g., full length, a variant, or a fragment thereof); MDC (e.g., full length, a variant, or a fragment thereof); MIP-1a (e.g., full length, a variant, or a fragment thereof); MIP-1b (e.g., full length, a variant, or a fragment thereof); TARC (e.g., full length, a variant, or a fragment thereof); GM-CSF (e.g., full length, a variant, or a fragment thereof); IL-12 23p40 (e.g., full length, a variant, or a fragment thereof); IL-15 (e.g., full length, a variant, or a fragment thereof); IL-16 (e.g., full length, a variant, or a fragment thereof); IL-17a (e.g., full length, a variant, or a fragment thereof); IL-1a (e.g., full length, a variant, or a fragment thereof); IL-5 (e.g., full length, a variant, or a fragment thereof); IL-7 (e.g., full length, a variant, or a fragment thereof); TNF-beta (e.g., full length, a variant, or a fragment thereof); or VEGF (e.g., full length, a variant, or a fragment thereof).

In some embodiments, the cytokine profile, e.g., cytokine secretion profile, comprises one, two, three, four, five, six, seven, or all of the following:
 (i) increased level, e.g., expression level, and/or activity of IL-2;
 (ii) reduced level, e.g., expression level, and/or activity of IL-1β;
 (iii) reduced level, e.g., expression level, and/or activity of IL-6;
 (iv) reduced level, e.g., expression level, and/or activity of TNFα;
 (v) reduced level, e.g., expression level, and/or activity of IL-10;
 (vi) a delay, e.g., at least 1, 2, 3, 4, 5, 6, 7, 8, 9, 10 or more hours delay, in increased level, e.g., expression level, and/or activity of IL-2;
 (vii) a delay, e.g., at least 1, 2, 3, 4, 5, 6, 7, 8, 9, 10 hours delay, in increased level, e.g., expression level, and/or activity of IFNg; or
 (viii) increased level, e.g., expression level, and/or activity of IL-15, e.g., wherein (i)-(viii) are relative to the cytokine profile, e.g., cytokine secretion profile, of the non-TCRβV-binding T cell engager.

In some embodiments, binding of the anti-TCRBV antibody to a TCRβV region results in reduced cytokine storm, e.g., reduced cytokine release syndrome (CRS) and/or neurotoxicity (NT), as measured by an assay of Example 3, e.g., relative to the cytokine storm induced by the non-TCRβV-binding T cell engager.

In some embodiments, binding of the anti-TCRBV antibody to a TCRβV region results in one, two, three or all of:
 (ix) reduced T cell proliferation kinetics;
 (x) cell killing, e.g., target cell killing, e.g. cancer cell killing, e.g., as measured by an assay of Example 4;
 (xi) increased Natural Killer (NK) cell proliferation, e.g., expansion; or (xii) expansion, e.g., at least about 1.1-10 fold expansion (e.g., at least about 1.1, 1.2, 1.3, 1.4, 1.5, 2, 3, 4, 5, 6, 7, 8, 9, or 10 fold expansion), of a population of memory T cells, e.g., wherein (ix)-(xii) are relative to the non-TCRβV-binding T cell engager.

In some embodiments, an anti-TCRβV antibody molecule disclosed herein recognizes (e.g., binds to), a structurally conserved domain on the TCRβV protein (e.g., as denoted by the circled area in FIG. 24A).

In some embodiments, an anti-TCRβV antibody molecule disclosed herein does not recognize, e.g., bind to, an interface of a TCRβV:TCRalpha complex.

In some embodiments, an anti-TCRβV antibody molecule disclosed herein does not recognize, e.g., bind to, a constant region of a TCRβV protein. An exemplary antibody that binds to a constant region of a TCRBV region is JOVI.1 as described in Viney et al., (*Hybridoma*. 1992 December; 11(6):701-13).

In some embodiments, an anti-TCRβV antibody molecule disclosed herein does not recognize, e.g., bind to, one or more (e.g., all) of a complementarity determining region (e.g., CDR1, CDR2 and/or CDR3) of a TCRβV protein.

In some embodiments of any of the compositions or methods disclosed herein, the anti-TCRβV antibody molecule comprises a light chain constant region chosen from the light chain constant regions of kappa or lambda, or a fragment thereof, e.g., as disclosed in Table 3.

In some embodiments of any of the compositions or methods disclosed herein, the anti-TCRβV antibody molecule comprises a light chain constant region of a kappa chain, or a fragment thereof, optionally wherein the kappa chain constant region comprises the sequence of SEQ ID NO: 39, or a sequence with at least 85%, 90%, 95%, or 99% sequence identity thereto In some embodiments of any of the compositions or methods disclosed herein, the anti-TCRβV antibody molecule comprises:
(i) one or more heavy chain constant regions comprising a heavy chain constant region chosen from IgG1, IgG2, IgG3, IgGA1, IgGA2, IgG4, IgJ, IgM, IgD, or IgE, or a fragment thereof, e.g., as described in Table 3; and
(ii) a light chain constant region comprising a light chain constant region chosen from the light chain constant regions of kappa or lambda, or a fragment thereof, e.g., as described in Table 3.

In some embodiments of any of the compositions or methods disclosed herein, the anti-TCRβV antibody molecule comprises or a cell comprising an anti-TCRβV antibody molecule comprises:
(i) a heavy chain comprising a variable region (VH), e.g., a VH of an antibody disclosed herein; and/or one or more heavy chain constant regions, e.g., as disclosed herein; and/or
(ii) a light chain comprising a variable light (VL), e.g., a VL of an antibody disclosed herein; and/or one or more light chain constant regions, e.g., as disclosed herein.

In some embodiments of any of the compositions or methods disclosed herein, the anti-TCRβV antibody molecule comprises, or a cell comprising an anti-TCRβV antibody molecule comprises:
(i) a heavy chain comprising a heavy chain constant region comprising:
 (a) an IgM heavy chain constant region or a fragment thereof, comprising the sequence of SEQ ID NO: 73, or a sequence with at least 85%, 90%, 95%, or 99% sequence identity thereto;
 (b) an IgGA1 heavy chain constant region or a fragment thereof, comprising the sequence of SEQ ID NO: 74, or a sequence with at least 85%, 90%, 95%, or 99% sequence identity thereto; or
 (c) an IgGA2 heavy chain constant region or a fragment thereof, comprising the sequence of SEQ ID NO: 75, or a sequence with at least 85%, 90%, 95%, or 99% sequence identity thereto; and
(ii) a light chain comprising a light chain constant region comprising a kappa chain constant region comprising the sequence of SEQ ID NO: 39, or a sequence with at least 85%, 90%, 95%, or 99% sequence identity thereto,
optionally wherein, the anti-TCRβV antibody molecule further comprises an IgJ heavy chain constant region or a fragment thereof, wherein the IgJ heavy chain constant region comprises the sequence of SEQ ID NO: 76 or a sequence with at least 85%, 90%, 95%, or 99% sequence identity thereto.

In some embodiments of any of the compositions or methods disclosed herein, the anti-TCRβV antibody molecule comprises, or a cell comprising an anti-TCRβV antibody molecule comprises:
(i) a heavy chain comprising: a VH chosen from a VH of Table 1 or 2, or a sequence with at least 85%, 90%, 95%, or 99% sequence identity thereto; and a heavy chain constant region comprising:
 (a) an IgM heavy chain constant region or a fragment thereof, comprising the sequence of SEQ ID NO: 73, or a sequence with at least 85%, 90%, 95%, or 99% sequence identity thereto;
 (b) an IgGA1 heavy chain constant region or a fragment thereof, comprising the sequence of SEQ ID NO: 74, or a sequence with at least 85%, 90%, 95%, or 99% sequence identity thereto; or
 (c) an IgGA2 heavy chain constant region or a fragment thereof, comprising the sequence of SEQ ID NO: 75, or a sequence with at least 85%, 90%, 95%, or 99% sequence identity thereto; and
(ii) a light chain comprising: a VL chosen from a VL of Table 1 or 2, or a sequence with at least 85%, 90%, 95%, or 99% sequence identity thereto; and a light chain constant region comprising a kappa chain constant region comprising the sequence of SEQ ID NO: 39, or a sequence with at least 85%, 90%, 95%, or 99% sequence identity thereto,
optionally wherein, the anti-TCRβV antibody molecule further comprises an IgJ heavy chain constant region or a fragment thereof, wherein the IgJ heavy chain constant region comprises the sequence of SEQ ID NO: 76 or a sequence with at least 85%, 90%, 95%, or 99% sequence identity thereto.

In some embodiments of any of the methods disclosed herein, the anti-TCRβV antibody molecule binds to one or more (e.g., all) of the following TCRβV subfamilies:
(i) TCRβ V6 subfamily comprising, e.g., one or more of TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01;
(ii) TCRβ V10 subfamily comprising, e.g., one or more of TCRβ V10-101, TCRβ V10-1*02, TCRβ V10-3*01 or TCRβ V10-2*01;
(iii) TCRβ V5 subfamily comprising, e.g., one or more of TCRβ V5-6*01, TCRβ V5-4*01, or TCRβ V5-8*01;
(iv) TCRβ V12 subfamily comprising e.g., one or more of TCRβ V12-4*01, TCRβ V12-3*01, or TCRβ V12-5*01;
(v) TCRβ V7 subfamily comprising e.g., one or more of TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01;
(vi) TCRβ V11 subfamily comprising e.g., one or more of TCRβ V11-1*01, TCRβ V11-2*01 or TCRβ V11-3*01;
(vii) TCRβ V14 subfamily comprising TCRβ V14*01;
(viii) TCRβ V16 subfamily comprising TCRβ V16*01;
(ix) TCRβ V18 subfamily comprising TCRβ V18*01;
(x) TCRβ V9 subfamily comprising T e.g., one or more of CRP V9*01 or TCRβ V9*02;
(xi) TCRβ V13 subfamily comprising TCRβ V13*01;
(xii) TCRβ V4 subfamily comprising e.g., one or more of e.g., one or more of TCRβ V4-2*01, TCRβ V4-3*01, or TCRβ V4-1*01;
(xiii) TCRβ V3 subfamily comprising TCRβ V3-1*01;
(xiv) TCRβ V2 subfamily comprising TCRβ V2*01;
(xv) TCRβ V15 subfamily comprising TCRβ V 15*01;
(xvi) TCRβ V30 subfamily comprising e.g., one or more of TCRβ V30*01, or TCRβ V30*02;
(xvii) TCRβ V19 subfamily comprising e.g., one or more of TCRβ V19*01, or TCRβ V19*02;
(xviii) TCRβ V27 subfamily comprising TCRβ V27*01;
(xix) TCRβ V28 subfamily comprising TCRβ V28*01;

(xx) TCRβ V24 subfamily comprising TCRβ V24-1*01;
(xxi) TCRβ V20 subfamily comprising e.g., one or more of TCRβ V20-1*01, or TCRβ V20-1*02;
(xxii) TCRβ V25 subfamily comprising TCRβ V25-1*01; or
(xxiii) TCRβ V29 subfamily comprising TCRβ V29-1*01;
(xxiv) TCRβ V21 subfamily;
(xxv) TCRβ V1 subfamily;
(xxvi) TCRβ V17 subfamily;
(xvii) TCRβ V23 subfamily; or
(xviii) TCRβ V26 subfamily.

In some embodiments of any of the methods disclosed herein, the anti-TCRβV antibody molecule binds to one or more (e.g., all) of the following TCRβV subfamilies:
(i) TCRβ V6, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01;
(ii) TCRβ V10, e.g., TCRβ V10-1*01, TCRβ V 10-1*02, TCRβ V 10-3*01 or TCRβ V10-2*01;
(iii) TCRβ V12, e.g., TCRβ V 12-4*01, TCRβ V 12-3*01, or TCRβ V 12-5*01; or (iv) TCRβ V5, e.g., TCRβ V5-5*01, TCRβ V5-6*01, TCRβ V5-4*01, TCRβ V5-8*01, TCRβ V5-1*01.

In some embodiments, the anti-TCRβV antibody molecule binds to TCRβ V6, e.g., TCRβV6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, the anti-TCRβV antibody molecule binds to TCRβ V6-5*01.

In some embodiments, the anti-TCRβV antibody molecule does not bind to TCRβ V12.

In some embodiments, the anti-TCRβV antibody molecule does not bind to TCRβ V5-5*01 or TCRβ V5-1*01.

In some embodiments of any of the methods disclosed herein, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments of any of the methods disclosed herein, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10 fold) the affinity and/or binding specificity of the 16G8 murine antibody or a humanized version thereof as described in U.S. Pat. No. 5,861,155.

In some embodiments of any of the methods disclosed herein, the anti-TCRβV antibody molecule binds to a TCRβV region other than TCRβ V12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments of any of the methods disclosed herein, the anti-TCRβV antibody molecule does not comprise at least one CDR of Antibody B. In some embodiments of any of the methods disclosed herein, the anti-TCRβV antibody molecule does not comprise the CDRs of Antibody B.

In some embodiments of any of the methods disclosed herein, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments of any of the methods disclosed herein, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments of any of the methods disclosed herein, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments of any of the methods disclosed herein, the anti-TCRβV antibody molecule does not comprise at least one CDR of the TM23 murine antibody. In some embodiments of any of the methods disclosed herein, the anti-TCRβV antibody molecule does not comprise the CDRs of the TM23 murine antibody.

In some embodiments of any of the methods disclosed herein, an anti-TCRβV antibody molecule disclosed herein does not comprise the sequence of a murine anti-rat TCR antibody R73, e.g., as disclosed in J Exp Med. 1989 Jan. 1; 169(1): 73-86, herein incorporated by reference in its entirety. In some embodiments of any of the methods disclosed herein, a multispecific antibody molecule disclosed herein does not comprise the sequence of a murine anti-rat TCR antibody R73, e.g., as disclosed in J Immunol. 1993 Mar. 15; 150(6):2305-15, herein incorporated by reference in its entirety.

In some embodiments of any of the methods disclosed herein, an anti-TCRβV antibody molecule disclosed herein does not comprise a viral peptide-WIC complex, e.g., as disclosed in Oncoimmunology. 2016; 5(1): e1052930, herein incorporated by reference in its entirety. In some embodiments of any of the methods disclosed herein, a multispecific antibody molecule disclosed herein does not comprise a viral peptide-WIC complex, e.g., as disclosed in Oncoimmunology. 2016; 5(1): e1052930, herein incorporated by reference in its entirety.

In some embodiments of a method disclosed herein, the immune cell population comprises a T cell, a Natural Killer cell, a B cell, an antigen presenting cell, or a myeloid cell (e.g., a monocyte, a macrophage, a neutrophil or a granulocyte).

In some embodiments of a method disclosed herein, the immune cell population comprises a T cell, e.g., a CD4+ T cell, a CD8+ T cell, a TCR alpha-beta T cell, or a TCR gamma-delta T cell. In some embodiments, a T cell comprises a memory T cell (e.g., a central memory T cell, or an effector memory T cell (e.g., a $T_{EMRA}$) or an effector T cell. In some embodiments, a T cell comprises a tumor infiltrating lymphocyte (TIL).

In some embodiments of a method disclosed herein, the immune cell population is obtained from a healthy subject.

In some embodiments of a method disclosed herein, the immune cell population is obtained from a subject (e.g., from an apheresis sample from the subject) having a disease, e.g., a cancer, e.g., as described herein. In some embodiments, the immune cell population obtained from a subject having a disease, e.g., a cancer, comprises a tumor infiltrating lymphocyte (TIL).

In some embodiments of a method disclosed herein, the method results in an expansion of at least 1.1-10 fold (e.g., at least 1.1, 1.2, 1.3, 1.4, 1.5, 2, 3, 4, 5, 6, 7, 8, 9, or 10 fold expansion).

In some embodiments of a method disclosed herein, the method further comprises contacting the population of cells with an agent that promotes, e.g., increases, immune cell expansion. In some embodiments, the agent includes an immune checkpoint inhibitor, e.g., as described herein. In some embodiments, the agent includes a 4-1BB (CD127) agonist, e.g., an anti-4-1BB antibody.

In some embodiments of a method disclosed herein, the method further comprises comprising contacting the population of cells with a non-dividing population of cells, e.g., feeder cells, e.g., irradiated allogenic human PBMCs.

In some embodiments of a method disclosed herein, an expansion method described herein comprises expanding the cells for a period of at least about 4 hours, 6 hours, 10 hours, 12 hours, 15 hours, 18 hours, 20 hours, or 22 hours, or for at least 1, 2, 3, 4, 5, 6, 7, 8, 9, 10, 11, 12, 13, 14, 15, 16, 17, 18, 19, 20 or 21 days, or for at least about 1 week, 2 weeks, 3 weeks, 4 weeks, 5 weeks, 6 weeks, 7 weeks or 8 weeks.

In some embodiments of a method disclosed herein, expansion of the population of immune cells, is compared to expansion of a similar population of cells with an antibody that binds to: a CD3 molecule, e.g., CD3 epsilon (CD3e) molecule; or a TCR alpha (TCRα) molecule.

In some embodiments of a method disclosed herein, expansion of the population of immune cells, is compared to expansion of a similar population of cells not contacted with the anti-TCRβV antibody molecule.

In some embodiments of a method disclosed herein, expansion of the population of memory effector T cells, e.g., TEM cells, e.g., $T_{EMRA}$ cells, is compared to expansion of a similar population of cells with an antibody that binds to: a CD3 molecule, e.g., CD3 epsilon (CD3e) molecule; or a TCR alpha (TCRα) molecule.

In some embodiments of a method disclosed herein, the method results in expansion of, e.g., selective or preferential expansion of, T cells expressing a T cell receptor (TCR) comprising a TCR alpha and/or TCR beta molecule, e.g., TCR alpha-beta T cells (αβ T cells).

In some embodiments of a method disclosed herein, the method results in expansion of αβT cells over expansion of T cells expressing a TCR comprising a TCR gamma and/or TCR delta molecule, e.g., TCR gamma-delta T cells (γδ T cells). In some embodiments, expansion of αβT cells over γδ T cells results in reduced production of cytokines associated with CRS. In some embodiments, expansion of αβT cells over γδ T cells results in immune cells that have reduced capacity to, e.g., are less prone to, induce CRS upon administration into a subject.

In some embodiments of a method disclosed herein, an immune cell population (e.g., T cells (e.g., $T_{EMRA}$ cells or TILs) or NK cells) cultured in the presence of, e.g., expanded with, an anti-TCRβV antibody disclosed herein does not induce CRS and/or NT when administered into a subject, e.g., a subject having a disease or condition as described herein.

In some embodiments, the anti-TCRβV antibody molecule in a multispecific molecule disclosed herein is a first immune cell engager moiety. In some embodiments, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155. In some embodiments, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155. In some embodiments, the anti-TCRβV antibody molecule binds to a TCRβV region other than TCRβV12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155. In some embodiments, the anti-TCRβV antibody molecule does not comprise the CDRs of the Antibody B murine antibody.

In some embodiments, the anti-TCRβV antibody molecule in a multispecific molecule disclosed herein is a first immune cell engager moiety. In some embodiments, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155. In some embodiments, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155. In some embodiments, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155. In some embodiments, the anti-TCRβV antibody molecule does not comprise the CDRs of the TM23 murine antibody.

In some embodiments, the multispecific molecule further comprises a second immune cell engager moiety. In some embodiments, the first and/or second immune cell engager binds to and activates an immune cell, e.g., an effector cell. In some embodiments, the first and/or second immune cell engager binds to, but does not activate, an immune cell, e.g., an effector cell. In some embodiments, the second immune cell engager is chosen from an NK cell engager, a T cell engager, a B cell engager, a dendritic cell engager, or a macrophage cell engager, or a combination thereof. In some embodiments, the second immune cell engager comprises a T cell engager which binds to CD3, TCRα, TCRγ, TCRζ, ICOS, CD28, CD27, HVEM, LIGHT, CD40, 4-1BB, OX40, DR3, GITR, CD30, TIM1, SLAM, CD2, or CD226.

In some embodiments, a multispecific molecule disclosed herein comprises a tumor targeting moiety. In some embodiment, the tumor-targeting moiety comprises an antibody molecule (e.g., Fab or scFv), a receptor molecule (e.g., a receptor, a receptor fragment or functional variant thereof), or a ligand molecule (e.g., a ligand, a ligand fragment or functional variant thereof), or a combination thereof, that binds to a cancer antigen. In some embodiments, the tumor-targeting moiety binds to a cancer antigen present on a cancer, e.g., a hematological cancer, a solid tumor, a metastatic cancer, soft tissue tumor, metastatic lesion, or a combination thereof. In some embodiments, the tumor-targeting moiety binds to a cancer antigen, e.g., BCMA or FcRH5.

In some embodiments, the tumor-targeting antibody molecule binds to a conformational or a linear epitope on the tumor antigen.

In some embodiments of any of the compositions or methods disclosed herein, the tumor-targeting moiety is an antigen, e.g., a cancer antigen. In some embodiments, the cancer antigen is a tumor antigen or stromal antigen, or a hematological antigen.

In some embodiments of any of the compositions or methods disclosed herein, the tumor-targeting moiety binds to a cancer antigen chosen from: BCMA, FcRH5, CD19, CD20, CD22, CD30, CD33, CD38, CD47, CD99, CD123, FcRH5, CLEC12, CD179A, SLAMF7, or NY-ESO1, PDL1, CD47, gangloside 2 (GD2), prostate stem cell antigen (PSCA), prostate specific membrane antigen (PMSA), prostate-specific antigen (PSA), carcinoembryonic antigen (CEA), Ron Kinase, c-Met, Immature laminin receptor, TAG-72, BING-4, Calcium-activated chloride channel 2, Cyclin-B1, 9D7, Ep-CAM, EphA3, Her2/neu, Telomerase, SAP-1, Survivin, NY-ESO-1/LAGE-1, PRAME, SSX-2, Melan-A/MART-1, Gp100/pme117, Tyrosinase, TRP-1/-2, MC1R, β-catenin, BRCA1/2, CDK4, CML66, Fibronectin, p53, Ras, TGF-B receptor, AFP, ETA, MAGE, MUC-1, CA-125, BAGE, GAGE, NY-ESO-1, f3-catenin, CDK4, CDC27, α actinin-4, TRP1/gp75, TRP2, gp 100, Melan-A/ MART 1, gangliosides, WT 1, EphA3, Epidermal growth factor receptor (EGFR), MART-2, MART-1, MUC 1, MUC2, MUM 1, MUM2, MUM3, NA88-1, NPM, OA1, OGT, RCC, RUI1, RUI2, SAGE, TRG, TRP1, TSTA, Folate receptor alpha, L1-CAM, CAIX, gpA33, GD3, GM2, VEGFR, Intergrins (Integrin alphaVbeta3, Integrin alpha5Beta1), Carbohydrates (Le), IGF1R, EPHA3, TRAILR1, TRAILR2, RANKL, (FAP), TGF-beta, hyaluronic acid, collagen, e.g., collagen IV, tenascin C, or tenascin W.

In some embodiments of any of the compositions or methods disclosed herein, the cancer is a solid tumor including but not limited to: pancreatic (e.g., pancreatic adenocarcinoma) cancer, breast cancer, colorectal cancer, lung cancer (e.g., small or non-small cell lung cancer), skin cancer, ovarian cancer, or liver cancer.

In some embodiments of any of the compositions or methods disclosed herein, the cancer antigen or tumor antigen is a hematological antigen. In some embodiments, the cancer or tumor antigen is chosen from one or more of: BCMA, FcRH5, CD19, CD20, CD22, CD30, CD33, CD38, CD47, CD99, CD123, FcRH5, CLEC12, CD179A, SLAMF7, orNY-ESO1. In some embodiments, the tumor-targeting moiety binds to one or both of BCMA or FcRH5.

In some embodiments, the tumor-targeting moiety binds to BCMA. In embodiments, the tumor-targeting moiety comprises a BCMA targeting moiety. In some embodiments, the tumor-targeting moiety comprising a BCMA targeting moiety binds to a BCMA antigen on the surface of a cell, e.g., a cancer or hematopoietic cell. The BCMA antigen can be present on a primary tumor cell, or a metastatic lesion thereof. In some embodiments, the cancer is a hematological cancer, e.g., multiple myeloma. For example, the BCMA antigen can be present on a tumor, e.g., a tumor of a class typified by having one or more of: limited tumor perfusion, compressed blood vessels, or fibrotic tumor interstitium. In some embodiments, the tumor targeting moiety comprising a BCMA targeting moiety comprises an anti-BCMA antibody or antigen-binding fragment thereof described in U.S. Pat. Nos. 8,920,776, 9,243,058, 9,340,621, 8,846,042, 7,083,785, 9,545,086, 7,276,241, 9,034,324, 7,799,902, 9,387,237, 8,821,883, US861745, US20130273055, US20160176973, US20150368351, US20150376287, US20170022284, US20160015749, US20140242077, US20170037128, US20170051068, US20160368988, US20160311915, US20160131654, US20120213768, US20110177093, US20160297885, EP3137500, EP2699259, EP2982694, EP3029068, EP3023437, WO2016090327, WO2017021450, WO2016110584, WO2016118641, WO2016168149, the entire contents of which are incorporated herein by reference.

In some embodiments, the BCMA-targeting moiety includes an antibody molecule (e.g., Fab or scFv) that binds to BCMA. In some embodiments, the antibody molecule to BCMA comprises one, two, or three CDRs from any of the heavy chain variable domain sequences of Table 14, or a closely related CDR, e.g., CDRs which have at least one amino acid alteration, but not more than two, three or four alterations (e.g., substitutions, deletions, or insertions, e.g., conservative substitutions) from any of the CDR sequences of Table 14. In some embodiments, the antibody molecule to BCMA comprises a heavy chain variable domain sequence chosen from any of the amino acid sequences of Table 14, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions)).

In some embodiments, the tumor-targeting moiety binds to FcRH5. In some embodiments, the tumor-targeting moiety comprises a FcRH5 targeting moiety. In some embodiments, the tumor-targeting moiety comprising a FcRH5 targeting moiety binds to a FcRH5 antigen on the surface of a cell, e.g., a cancer or hematopoietic cell. The FcRH5 antigen can be present on a primary tumor cell, or a metastatic lesion thereof. In some embodiments, the cancer is a hematological cancer, e.g., multiple myeloma. For example, the FcRH5 antigen can be present on a tumor, e.g., a tumor of a class typified by having one or more of: limited tumor perfusion, compressed blood vessels, or fibrotic tumor interstitium. In some embodiments, the tumor targeting moiety comprising a FcRH5 targeting moiety comprises an anti-FcRH5 antibody or antigen-binding fragment thereof described in U.S. Pat. No. 7,999,077 the entire contents of which are incorporated herein by reference.

In some embodiments of any of the compositions or methods disclosed herein, the cancer is a hematological cancer including, but not limited to: a B-cell or T cell malignancy, e.g., Hodgkin's lymphoma, Non-Hodgkin's lymphoma (e.g., B cell lymphoma, diffuse large B cell lymphoma, follicular lymphoma, chronic lymphocytic leukemia, mantle cell lymphoma, marginal zone B-cell lymphoma, Burkitt lymphoma, lymphoplasmacytic lymphoma, hairy cell leukemia), acute myeloid leukemia (AML), chronic myeloid leukemia, myelodysplastic syndrome, multiple myeloma, and acute lymphocytic leukemia. In some embodiments, the hematological cancer is multiple myeloma.

In some embodiments, a multispecific molecule disclosed herein further comprises a cytokine molecule, e.g., one or two cytokine molecules. In some embodiments, the cytokine molecule is chosen from interleukin-2 (IL-2), interleukin-7 (IL-7), interleukin-12 (IL-12), interleukin-15 (IL-15), interleukin-18 (IL-18), interleukin-21 (IL-21), or interferon gamma, or a fragment, variant or combination thereof. In some embodiments, is a monomer or a dimer. In some embodiments, the cytokine molecule further comprises a receptor dimerizing domain, e.g., an IL15Ralpha dimerizing domain. In some embodiments, the cytokine molecule (e.g., IL-15) and the receptor dimerizing domain (e.g., an IL15Ralpha dimerizing domain) are not covalently linked, e.g., are non-covalently associated.

In some embodiments, a multispecific molecule disclosed herein comprises:
(i) an anti-TCRβV antibody molecule (e.g., an anti-TCRβV antibody molecule as described herein); and
(ii) a tumor-targeting antibody molecule (e.g., an antibody molecule that binds to a hematological antigen as described herein, e.g., chosen from one or more of BCMA, FcRH5, CD19, CD22, CD33, CD123, FcRH5, CD179a, or CLEC12).

In some embodiments, the multispecific molecule disclosed herein comprises the anti-TCRβV antibody molecule of (i), the tumor-targeting antibody molecule of (ii) and a cytokine molecule as described herein, e.g., an IL-12 cytokine molecule.

In some embodiments, the multispecific molecule comprises an anti-TCRβV antibody molecule as described herein; and a tumor-targeting antibody molecule that binds to one or both of BCMA or FcRH5. In some embodiments, the multispecific molecule further comprises an IL-12 cytokine molecule. The multispecific molecule can be used to treat a BCMA- or FcRH5-expressing hematological cancer, e.g., multiple myeloma.

In some embodiments, the multispecific molecule comprises an anti-TCRβV antibody molecule as described herein; and a tumor-targeting antibody molecule that binds one or more of CD19, CD22, or CD123. In some embodiments, the multispecific molecule further comprises an IL-12 cytokine molecule. The multispecific molecule can be used to treat a CD19-, CD22-, or CD123-expressing hematological cancer, e.g., leukemia or lymphoma. In some embodiments, the CD19-, CD22-, or CD123-expressing hematological cancer is chosen from a B-cell or T cell malignancy, e.g., Hodgkin's lymphoma, Non-Hodgkin's lymphoma (e.g., B cell lymphoma, diffuse large B cell lymphoma, follicular lymphoma, chronic lymphocytic leukemia, mantle cell lymphoma, marginal zone B-cell lymphoma, Burkitt lymphoma, lymphoplasmacytic lymphoma, hairy cell leukemia), acute myeloid leukemia (AML), chronic myeloid leukemia, myelodysplastic syndrome, multiple myeloma, and acute lymphocytic leukemia. In some embodiments, the hematological cancer is multiple myeloma.

In some embodiments, a multispecific molecule disclosed herein further comprises an immunoglobulin constant region (e.g., Fc region) chosen from the heavy chain constant regions of IgG1, IgG2, and IgG4, more particularly, the heavy chain constant region of human IgG1, IgG2 or IgG4. In some embodiments, the immunoglobulin constant region (e.g., an Fc region) is linked, e.g., covalently linked to, one or more of tumor-targeting moiety, the immune cell engager, the cytokine molecule, or the stromal modifying moiety. In some embodiments, an interface of a first and second immunoglobulin chain constant regions (e.g., Fc region) is altered, e.g., mutated, to increase or decrease dimerization, e.g., relative to a non-engineered interface. In some embodiments, the dimerization of the immunoglobulin chain constant region (e.g., Fc region) is enhanced by providing an Fc interface of a first and a second Fc region with one or more of: a paired cavity-protuberance ("knob-in-a hole"), an electrostatic interaction, or a strand-exchange, such that a greater ratio of heteromultimer:homomultimer forms, e.g., relative to a non-engineered interface. In some embodiments, In some embodiments, a multispecific molecule disclosed herein further comprises a linker, e.g., a linker described herein, optionally wherein the linker is selected from: a cleavable linker, a non-cleavable linker, a peptide linker, a flexible linker, a rigid linker, a helical linker, or a non-helical linker.

In some embodiments, the multi specific molecule comprises at least two non-contiguous polypeptide chains.

In some embodiments, the multispecific molecule comprises the following configuration:

A, B-[dimerization module]-C, -D wherein:
(1) the dimerization module comprises an immunoglobulin constant domain, e.g., a heavy chain constant domain (e.g., a homodimeric or heterodimeric heavy chain constant region, e.g., an Fc region), or a constant domain of an immunoglobulin variable region (e.g., a Fab region); and
(2) A, B, C, and D are independently absent; (i) an antigen binding domain that preferentially binds to a first immune cell engager comprising an anti-TCRβV antibody molecule disclosed herein; (ii) a tumor targeting moiety (e.g., a tumor-targeting antibody molecule as described herein), (iii) a second immune cell engager chosen from a T cell engager, an NK cell engager, a B cell engager, a dendritic cell engager, or a macrophage cell engager; (iv) a cytokine molecule; or (v) a stromal modifying moiety, provided that:
at least one, two, or three of A, B, C, and D comprises an antigen binding domain that preferentially binds to a TCRβV region disclosed herein, and
any of the remaining A, B, C, and D is absent or comprises one of a tumor targeting moiety, a second immune cell engager, a cytokine molecule, or a stromal modifying moiety.

In some embodiments, the dimerization module comprises one or more immunoglobulin chain constant regions (e.g., Fc regions) comprising one or more of: a paired cavity-protuberance ("knob-in-a hole"), an electrostatic interaction, or a strand-exchange. In some embodiments, the one or more immunoglobulin chain constant regions (e.g., Fc regions) comprise an amino acid substitution at a position chosen from one or more of 347, 349, 350, 351, 366, 368, 370, 392, 394, 395, 397, 398, 399, 405, 407, or 409, e.g., of the Fc region of human IgG1. In some embodiments, the one or more immunoglobulin chain constant regions (e.g., Fc regions) comprise an amino acid substitution chosen from: T366S, L368A, or Y407V (e.g., corresponding to a cavity or hole), or T366W (e.g., corresponding to a protuberance or knob), or a combination thereof.

In some embodiments, the multispecific molecule further comprises a linker, e.g., a linker between one or more of: the antigen binding domain of an anti-TCRβV antibody molecule disclosed herein and the tumor targeting moiety; the antigen binding domain of an anti-TCRβV antibody molecule disclosed herein and the second immune cell engager, the antigen binding domain of an anti-TCRβV antibody molecule disclosed herein and the cytokine molecule, the antigen binding domain of an anti-TCRβV antibody molecule disclosed herein and the stromal modifying moiety, the second immune cell engager and the cytokine molecule, the second immune cell engager and the stromal modifying moiety, the cytokine molecule and the stromal modifying moiety, the antigen binding domain of an anti-TCRβV antibody molecule disclosed herein and the dimerization module, the second immune cell engager and the dimerization module, the cytokine molecule and the dimerization module, the stromal modifying moiety and the dimerization module, the tumor targeting moiety and the dimerization module, the tumor targeting moiety and the cytokine molecule, the tumor targeting moiety and the second immune cell engager, or the tumor targeting moiety and the antigen binding domain of an anti-TCRβV antibody molecule disclosed herein. In some embodiments, the linker is chosen from: a cleavable linker, a non-cleavable linker, a peptide linker, a flexible linker, a rigid linker, a helical linker, or a non-helical linker. In some embodiments, the linker is a peptide linker. In some embodiments, the peptide linker comprises Gly and Ser. In some embodiments, the peptide linker comprises an amino acid sequence chosen from SEQ ID NOs: 142-145 or 175-178.

In some embodiments of a method or composition for use disclosed herein, the disease is a cancer chosen from: a hematological cancer, a solid tumor, a metastatic cancer, soft tissue tumor, metastatic lesion, or a combination thereof.

In some embodiments of a method or composition for use disclosed herein, the cancer is a solid tumor chosen from: a melanoma, a pancreatic cancer (e.g., pancreatic adenocarcinoma), a breast cancer, a colorectal cancer (CRC), a lung cancer (e.g., small or non-small cell lung cancer), a skin cancer, an ovarian cancer, or a liver cancer. In some embodiments, the cancer is melanoma or CRC.

In some embodiments of a method or composition for use disclosed herein the cancer is a hematological cancer chosen from: a B-cell or T cell malignancy, e.g., Hodgkin's lymphoma, Non-Hodgkin's lymphoma (e.g., B cell lymphoma, diffuse large B cell lymphoma, follicular lymphoma, chronic lymphocytic leukemia, mantle cell lymphoma, marginal zone B-cell lymphoma, Burkitt lymphoma, lymphoplasmacytic lymphoma, hairy cell leukemia), acute myeloid leukemia (AML), chronic myeloid leukemia, myelodysplastic syndrome, multiple myeloma, or acute lymphocytic leukemia. In some embodiments, the hematological cancer is multiple myeloma. In some embodiments, the hematological cancer is CLL or DLBCL.

In some embodiments of a method or composition for use disclosed herein the sample from the subject comprises a blood sample, e.g., a peripheral blood sample, a biopsy, e.g., a tumor biopsy, or a bone marrow sample. IN some embodiments, the sample comprises a biological sample comprising immune effector cells, e.g., T cells, or NK cells. In some embodiments, T cells comprise a CD4 T cell, a CD8 T cell, (e.g., an effector T cell or a memory T cell (e.g., a memory effector T cell (e.g., TEM cell, e.g., $T_{EMRA}$ cell), or a tumor infiltrating lymphocyte (TIL).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and are not intended to be limiting.

Other features and advantages of the invention will be apparent from the following detailed description and claims.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIGS. 1A-1B shows the alignment of the Antibody A source mouse VH and VL framework 1, CDR 1, framework 2, CDR 2, framework 3, CDR3, and framework 4 regions with their respective humanized sequences. Kabat CDRs are shown in bold, Chothia CDRs are shown in italics, and combined CDRs are shown in boxes. The framework positions that were back mutated are double underlined. FIG. 1A shows VH sequences for murine Antibody A (SEQ ID NO: 1) and humanized Antibody A-H (SEQ ID NO: 9). FIG. 1B shows VL sequences for murine Antibody A (SEQ ID NO: 2) and humanized Antibody A-H (SEQ ID NO: 10 and SEQ ID NO: 11).

FIGS. 2A-2B shows the alignment of the Antibody B source mouse VH and VL framework 1, CDR 1, framework 2, CDR 2, framework 3, CDR3, and framework 4 regions with their respective humanized sequences. Kabat CDRs are shown in bold, Chothia CDRs are shown in italics, and combined CDRs are shown in boxes. The framework positions that were back mutated are double underlined. FIG. 2A shows the VH sequence for murine Antibody B (SEQ ID NO: 15) and humanized VH sequences B-H.1A to B-H.1C (SEQ ID NOs: 23-25). FIG. 2B shows the VL sequence for murine Antibody B (SEQ ID NO: 16) and humanized VL sequences B-H.1D to B-H.1H (SEQ ID NOs: 26-30).

FIG. 4A shows two scatter plots (left: activated with OKT3; and right: activated with A-H.1) of expanded T cells assessed for TCR Vβ13.1 surface expression using anti-TCR Vβ13.1 (A-H.1) followed by a secondary fluorochrome-conjugated antibody for flow cytometry analysis. FIG. 4B shows percentage (%) of TCR Vβ13.1 positive T cells activated by anti-TCR Vβ13.1 (A-H.1) or anti-CD3e (OKT3) plotted against total T cells (CD3+). FIG. 4C shows relative cell count acquired by counting the number of events in each T cell subset gate (CD3 or TCR Vβ13.1) for 20 seconds at a constant rate of 60111/min. Data shown as mean value from 3 donors.

FIG. 5A depicts target cell lysis of human CD3+ T cells activated with A-H.1 or OKT3. Human CD3+ T cells were isolated using magnetic-bead separation (negative selection) and activated with immobilized (plate-coated) A-H.1 or OKT3 at the indicated concentrations for 4 days prior to co-culture with RPMI 8226 cells at a (E:T) ratio of 5:1 for 2 days. Samples were next analyzed for cell lysis of RPMI 8226 cells by FACS staining for CFSE/CD138-labeled, and membrane-impermeable DNA dyes (DRAQ7) using flow cytometry analysis. FIG. 5B shows target cell lysis of human CD3+ T cells activated with A-H.1 or OKT3 incubated with RPMI-8226 at a (E:T) ratio of 5:1 for 6 days followed by cell lysis analysis of RPMI 8226 cells as described above. Percentage (%) target cell lysis was determined by normalizing to basal target cell lysis (i.e. without antibody treatment) using the following formula, [(x−basal)/(100%−basal), where x is cell lysis of sample]. Data shown is a representative of n=1 donor.

FIG. 6A is a graph comparing the production of IFNg in human PBMCs activated with the antibodies indicated activated with anti-TCR Vβ13.1 antibodies (A-H.1 or A-H.2) or anti-CD3e antibodies (OKT3 or SP34-2) on Day 1, 2, 3, 5, or 6 post-activation. FIG. 6B shows IFNg production in human PBMCs activated with the antibodies indicated activated with the indicated anti-TCR Vβ13.1 antibodies or anti-CD3e antibody (OKT3) on Day 1, 2, 3, 5, or 6 post-activation.

FIG. 11A shows IFNg secretion data from 4 donors. FIG. 11B shows IFNg secretion data from 4 additional donors. Data shown is representative of n=8 donors.

FIG. 13A is a graph depicting proliferation of T cells activated with anti-CD3 (OKT3) antibody or anti-TCRVb antibody. FIG. 13B shows selective expansion of CD45RA+ effector memory CD8+ and CD4+ T cells (TEMRA) cells with anti-TCRVb antibodies. Tn=naïve T cell; Tscm=stem cell memory T cell; Tcm=central memory T cell; Tem=effector memory T cell; Temra=effector memory CD45RA+ T cell. FIG. 13C is a graph showing IFN-g secretion by PBMCs stimulated with an anti-TCRVb antibody, or anti-CD3 antibodies. FIG. 13D shows target cell lysis by T cells stimulated with an anti-TCRVb antibody, or anti-CD3 antibodies. Cells were stimulated for 4 days followed by 2 days incubation with multiple myeloma target cells for assessment of cell killing. FIG. 13E is a graph showing perforin secretion by T cells stimulated with an anti-TCRVb antibody, or an anti-CD3 antibody. Perforin was analyzed by FACS staining in TCRVB-positive and TCRVB-negative T cells in PBMCs after 5 days of stimulation with 100 ng/ml plate-bound antibody. FIG. 13F is a graph showing Granzyme B by T cells stimulated with an anti-TCRVb antibody, or an anti-CD3 antibody. Granzyme B was analyzed by FACS staining in TCRVB-positive and TCRVB-negative T cells in PBMCs after 5 days of stimulation with 100 ng/ml plate-bound antibody.

FIGS. 14A-14B show production of IL-2 and IL-15 and expansion of human NK cells by stimulation of PBMCs with anti-TCRVb antibody for 6 days at a dose of 100 nM. FIG. 14A shows secretion of IL-2 or IL-15 in T cells stimulated with an anti-TCRVb antibody, or anti-CD3 antibodies. FIG. 14B depicts flow cytometry dot plots showing NKp46 staining vs CD56 antibody staining in cells stimulated with an anti-TCRVb antibody or an anti-CD3 antibody or a control sample.

FIG. 16A shows in vitro killing by one of the following dual-targeting antibody molecules: BCMA-TCRVb (Molecule I), BCMA-CD3, or Control-TCRVb; or an isotype control. FIG. 16B shows in vivo killing of MM cells by a dual-targeting BCM-TCRVb antibody (Molecule I).

FIG. 18A shows that human PBMCs activated by anti-TCR Vβ8a antibodies (B-H.1) produce similar or reduced levels of IFNγ. FIG. 18B shows human PBMCs activated by anti-TCR Vβ8a antibodies (B-H.1) produce higher levels of IL-2 when compared to those activated by anti-CD3ε antibodies (OKT3 or SP34-2). Data shown is representative of n=6 donors.

FIGS. 19A-19C demonstrate cytokine production from human PBMCs activated by anti-TCR Vβ8a antibodies (B-H.1). Human PBMCs activated by anti-TCR Vβ8a antibodies (B-H.1) do not significantly produce IL-6 (FIG. 19A), IL1b (FIG. 19B), and less TNFα (FIG. 19C), when compared to PBMCs activated by anti-CD3ε antibodies (OKT3 or SP34-2). Data shown is representative of n=6 donors.

FIGS. 20A-20E demonstrate cytokine production from human PBMCs activated by anti-TCRβV Antibody D antibody compared to control anti-CD3e antibody (OKT3). FIG. 20A shows that human PBMCs activated by anti-TCRβV Antibody D antibody produce similar or reduced levels of IFNγ. FIG. 20B shows human PBMCs activated by anti-TCRβV Antibody D antibody produce higher levels of IL-2 when compared to those activated by anti-CD3ε antibodies (OKT3). Human PBMCs activated by anti-TCRβV Antibody D antibody do not significantly produce IL-1beta (FIG. 20C), IL-6, (FIG. 20D), or TNFalpha (FIG. 20E). Data shown is representative of n=4 donors.

FIG. 21A shows that human PBMCs activated by anti-TCR Vβ5 antibody produce similar or reduced levels of IFNγ compared to PBMCS activated by anti-CD3ε antibodies (OKT3 or SP34-2). FIG. 21B shows human PBMCs activated by the anti-TCR Vβ5 1 antibody produce higher levels of IL-2 when compared to those activated by anti-CD3ε antibodies (OKT3 or SP34-2). Data shown is representative of n=4 donors.

FIGS. 22A-2D demonstrate cytokine production from human PBMCs activated by an anti-TCR Vβ5 antibody (Antibody E). Human PBMCs activated by anti-TCR Vβ5 antibody do not significantly produce IL-1beta (FIG. 22A), IL-6, (FIG. 22B), TNFalpha (FIG. 22C), or IL-10 (FIG. 22D) as compared to PBMCs activated by anti-CD3ε antibodies (OKT3 or SP34-2). Data shown is representative of n=4 donors.

FIG. 23A shows that human PBMCs activated by the bispecific molecule produce similar or reduced levels of IFNγ as PBMCS activated by anti-CD3ε antibodies (OKT3). FIG. 23B shows human PBMCs activated by the bispecific molecule produce higher levels of IL-2 when compared to PBMCs activated by anti-CD3ε antibodies (OKT3). Human PBMCs activated by the bispecific molecule do not significantly produce IL-1beta (FIG. 23C), IL-6, (FIG. 23D), TNFalpha (FIG. 23E), or IL-10 (FIG. 23F). Data shown is representative of n=3 donors.

FIGS. 24A-24B show the structure and sequence of eight TCRβV proteins from seven different subfamilies: TCRβV6 subfamily (TCRβV6-5 and TCRβV6-4 are shown), TCRβV28 subfamily, TCRβV19 subfamily, TCRβV9 subfamily, TCRβV5 subfamily, TCRβV20 subfamily and TCRβV12 subfamily. FIG. 24A shows the structural alignment of the different TCRβV proteins. The circled area represents the outward facing region comprising the proposed binding site for the anti-TCRβV antibodies disclosed herein. FIG. 24B shows the amino acid sequence alignment of the proteins shown in FIG. 24A (SEQ ID NOS 3449-3456, respectively, in order of appearance). The various TCRβV proteins (from 7 different TCRβV subfamilies) have diverse sequences but share a conserved (similar) structure and function.

FIGS. 25A-25J show cytokine or chemokine secretion of PBMCs activated with anti-TCRVb antibodies (A-H.1, B-H.1), a bispecific molecule comprising an anti-TCRVb antibody (Molecule H), control isotype (122) or anti-CD3e antibody (OKT3). Data shown is representative of n=2 donors and representative of 2 independent experiments.

FIGS. 26A-26H show cytokine or chemokine secretion of PBMCs activated with anti-TCRVb antibodies (A-H.1, B-H.1), a bispecific molecule comprising an anti-TCRVb antibody (Molecule H), control isotype (122) or anti-CD3e antibody (OKT3). Data shown is representative of n=2 donors and representative of 2 independent experiments.

FIGS. 27A-27L show cytokine or chemokine secretion of PBMCs activated with anti-TCRVb antibodies (A-H.1, B-H.1), a bispecific molecule comprising an anti-TCRVb antibody (Molecule H), control isotype (122) or anti-CD3e antibody (OKT3). Data shown is representative of n=2 donors and representative of 2 independent experiments.

FIG. 29A shows mean tumor burden at days 16 to 37 in NOD/SCID/IL-2Rγnull (NSG) mice engrafted with Raji-luc cells. FIG. 29B shows mean tumor burden (Total Flux) at days 16 to 30 in animals engrafted with K562-luc cells.

FIG. 31A shows data generated using anti-TCR Vβ13.1/anti-CD 19 (Molecule F), anti-CD3/anti-CD19, and anti-TCR Vβ13.1 (A-H.1). FIG. 31B shows data generated using anti-TCR Vβ13.1/anti-BCMA (Molecule G), anti-CD3/anti-BCMA, and anti-TCR Vβ13.1 (A-H.1).

FIGS. 32A-32F are graphs showing cytokine secretion stimulated by anti-TCR Vβ/anti-BCMA (Molecule H) or anti-CD3 (OKT3) at Days 1, 2, 3, and 5. Cytokines examined include: IFNγ, IL-2, IL-1β, IL-6, IL-10, and TNFα (FIGS. 32A-32F, respectively).

FIG. 34 is Table 9 showing alignment of TCRBV amino acid sequences (SEQ ID NOS 3457-3639, respectively, in order of appearance). The alignment of TCRBV amino acid sequences in Table 9 underscores the diversity of TCR sequences. In particular, the TRBV sequences from different subfamilies are considerably different from each other.

FIGS. 35A and 35B show alignment of affinity matured humanized Antibody A-H VL sequences (SEQ ID NOS 3377-3389, respectively, in order of appearance) (FIG. 35A) and alignment of affinity matured humanized Antibody A-H VH sequences (SEQ ID NOS 3390-3436, respectively, in order of appearance) (FIG. 35B), respectively.

DETAILED DESCRIPTION OF THE INVENTION

Figure 3:
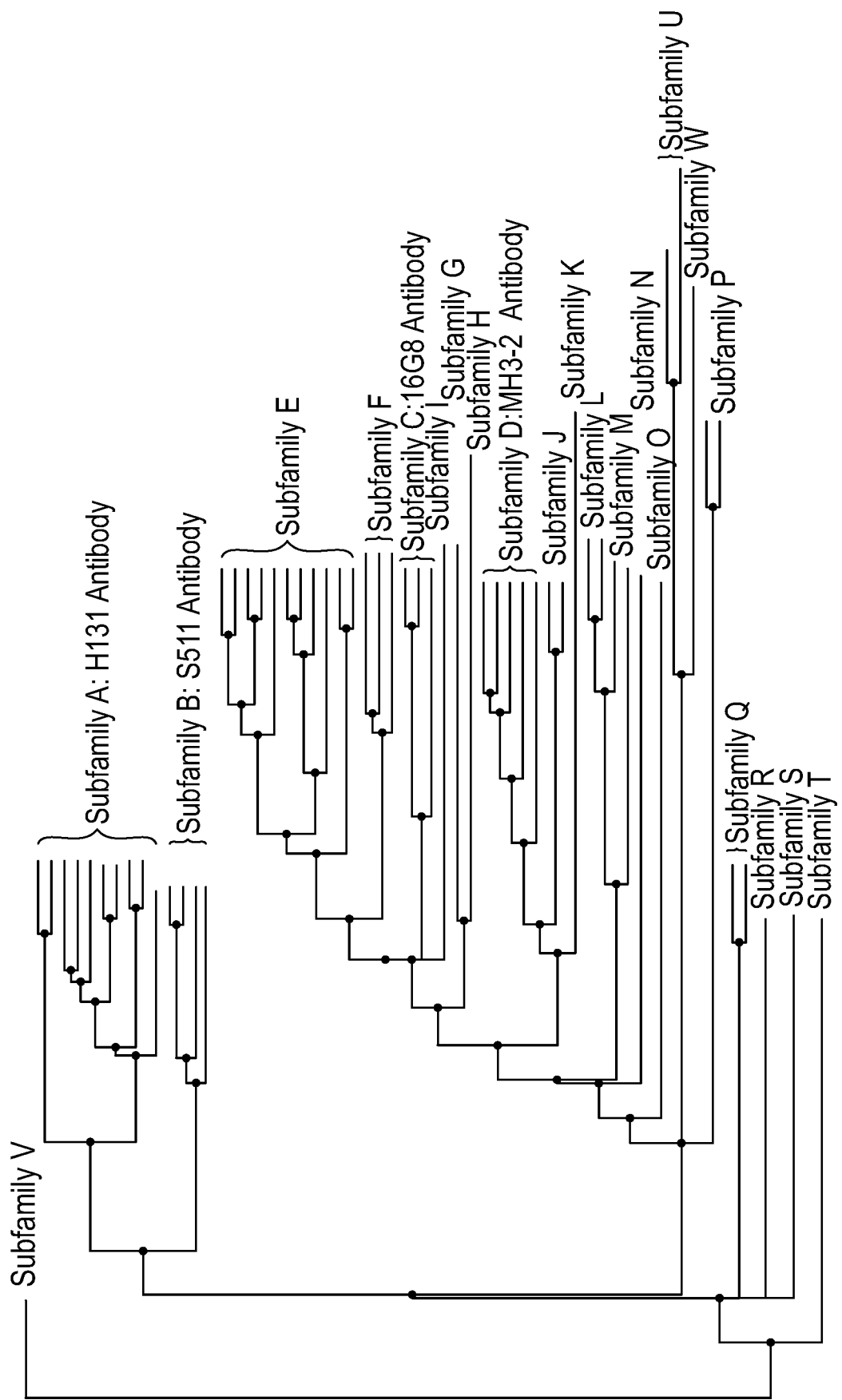
FIG. 3 depicts the phylogenetic tree of TCRBV gene family and subfamilies with corresponding antibodies mapped. Subfamily identities are as follows: Subfamily A: TCRβ V6; Subfamily B: TCRβ V10; Subfamily C: TCRβ V12; Subfamily D: TCRβ V5; Subfamily E: TCRβ V7; Subfamily F: TCRβ V11; Subfamily G: TCRβ V14; Subfamily H: TCRβ V16; Subfamily I:TCRβ V18; Subfamily J:TCRβ V9; Subfamily K: TCRβ V13; Subfamily L: TCRβV4; Subfamily M:TCRβ V3; Subfamily N:TCRβ V2; Subfamily O:TCRβ V15; Subfamily P: TCRβ V30; Subfamily Q: TCRβ V19; Subfamily R:TCRβ V27; Subfamily S:TCRβ V28; Subfamily T: TCRβ V24; Subfamily U: TCRβ V20; Subfamily V: TCRβ V25; and Subfamily W:TCRβ V29 subfamily. Subfamily members are described in detail herein in the Section titled "TCR beta V (TCRβV)".

Current bispecific constructs designed to redirect T cells to promote tumor cell lysis for cancer immunotherapy typically utilize antibody fragments (Fab, scFv, VH, etc.)

that are derived from monoclonal antibodies (mAb) directed against the CD3e subunit of the T cell receptor (TCR). However, there are limitations to this approach which may prevent the full realization of the therapeutic potential for such bispecific constructs. Previous studies have shown that even low "activating" doses of anti-CD3e mAb can cause long-term T cell dysfunction and exert immunosuppressive effects. In addition, anti-CD3e mAbs have been associated with side effects that result from massive T cell activation. The large number of activated T cells secrete substantial amounts of cytokines, the most important of which is Interferon gamma (IFNg). This excess amount of IFNg in turn activates macrophages which then overproduce proinflammatory cytokines such as IL-1beta, IL-6, IL-10 and TNF-alpha, causing a "cytokine storm" known as the cytokine release syndrome (CRS) (Shimabukuro-Vornhagen et al., J Immunother Cancer. 2018 Jun. 15; 6(1):56, herein incorporated by reference in its entirety). Thus, the need exists for developing antibodies that are capable of binding and activating only a subset of effector T cells, e.g., to reduce the CRS and/or neurotoxicity (NT).

This invention features molecules targeting the TCRβV chain of TCR and methods thereof. Without wishing to be bound by theory, such molecules are capable of binding, activating, and/or expanding only a subset of T cells, avoiding or reducing CRS and/or NT and minimizing potential immunosuppressive effects of anti-CD3 mAbs.

TCR is a disulfide-linked membrane-anchored heterodimeric protein normally consisting of the highly variable alpha (α) and beta (β) chains expressed as part of a complex with the invariant CD3 chain molecules. TCR on αβ T cells is formed by a heterodimer of one alpha chain and one beta chain. Each alpha or beta chain consists of a constant domain and a highly variable domain classified as the Immunoglobulin superfamily (IgSF) fold. The TCRβV chains can be further classified into 30 subfamilies (TRBV1-30). Despite their high structural and functional homology, the amino acid sequence homology in the TRBV genes is very low. Only 4 amino acids out of ~95 are identical while 10 additional amino acids are conserved among all subfamilies (see an alignment of TCRBV amino acid sequences in Table 9). Nevertheless, TCRs formed between alpha and beta chains of highly diverse sequences show a remarkable structural homology (FIGS. 24A and 24B) and elicit a similar function, e.g., activation of T cells.

Disclosed herein is the discovery of a novel class of antibodies, i.e., anti-TCRβV antibody molecules disclosed herein, which despite having low sequence similarity (e.g., low sequence identity among the different antibody molecules that recognize different TCRβV subfamilies), recognize a structurally conserved, yet sequence-wise variable, region, e.g., domain, on the TCRβV protein (as denoted by the circled area in FIG. 24A) and have a similar function (e.g., activation of T cells and a similar cytokine profile as described herein). Thus, the anti-TCRβV antibody molecules disclosed herein share a structure-function relationship.

Figure 24A:
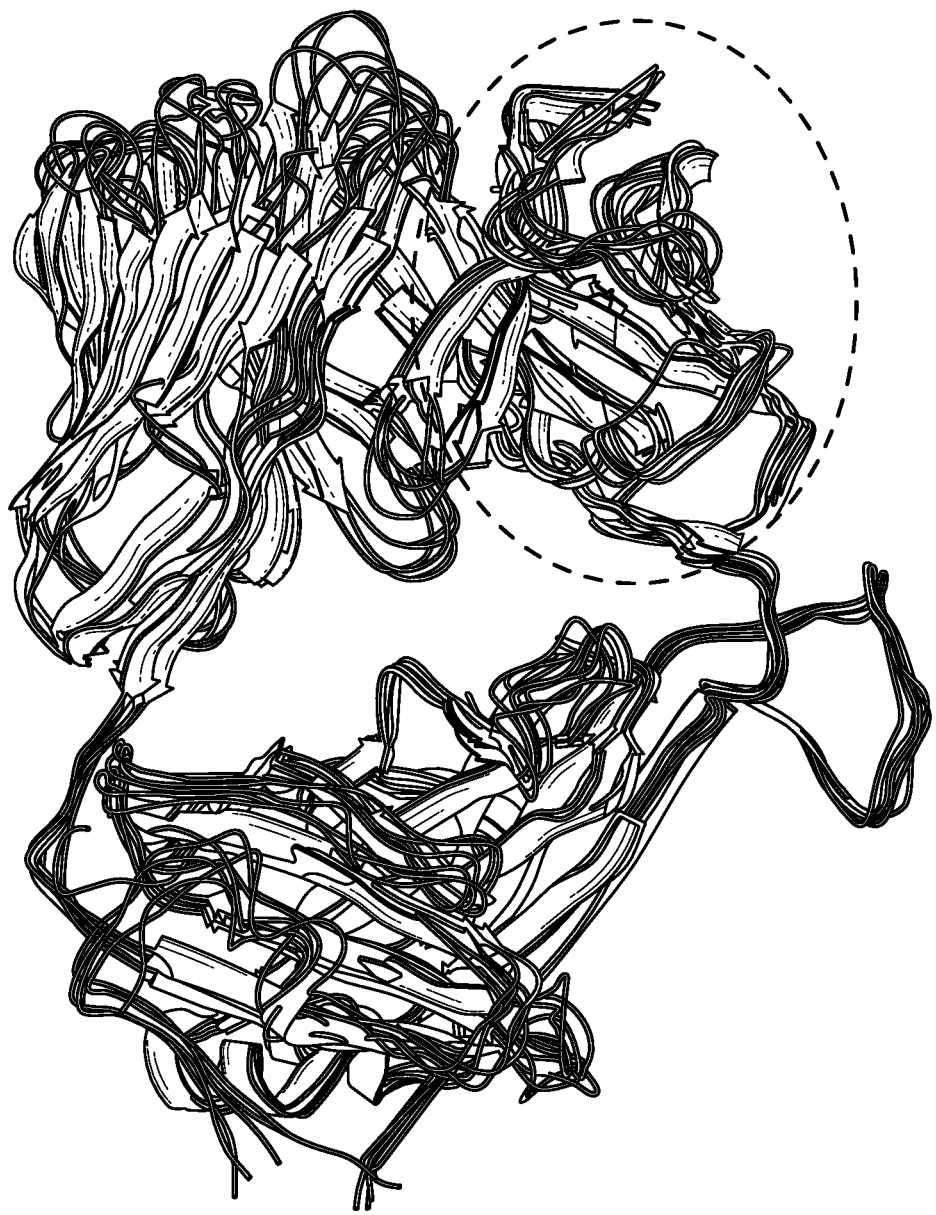

Without wishing to be bound by theory, it is believed that in some embodiments, the anti-TCRβV antibody molecules disclosed herein bind to an outward facing epitope of a TCRβV protein when it is in a complex with a TCRalpha protein, e.g., as denoted by the circled area in FIG. 24A. In some embodiments, the anti-TCRβV antibody molecules disclosed herein recognize (e.g., bind to), a domain (e.g., an epitope) on the TCRβV protein that is: (1) structurally conserved among different TCRβV subfamilies; and (2) has minimal sequence identity among the different TCRβV subfamilies. As shown in Table 9, TCRβV proteins from the different TCRBV subfamilies share minimal sequence similarity. However, as shown in FIG. 24A-B, TCRβV proteins which have minimal sequence similarity, share a similar 3D conformation and structure.

In some embodiments, the anti-TCRβV antibody molecules disclosed herein do not recognize, e.g., bind to, an interface of a TCRβV:TCRalpha complex.

In some embodiments, the anti-TCRβV antibody molecules disclosed herein do not recognize, e.g., bind to, a constant region of a TCRβV protein.

In some embodiments, the anti-TCRβV antibody molecules disclosed herein do not recognize, e.g., bind to, one or more (e.g., all) of a complementarity determining region (e.g., CDR1, CDR2 and/or CDR3) of a TCRβV protein.

This disclosure provides, inter alia, antibody molecules directed to the variable chain of the beta subunit of TCR (TCRβV) which bind and, e.g., activate a subset of T cells. The anti-TCRβV antibody molecules disclosed herein result in lesser or no production of cytokines associated with CRS, e.g., IL-6, IL-1beta, IL-10 and TNF alpha; and enhanced and/or delayed production of IL-2 and IFNg. In some embodiments, the anti-TCRβV antibodies disclosed herein have a cytokine profile, e.g., as described herein, which differs from a cytokine profile of a T cell engager that binds to a receptor or molecule other than a TCRβV region ("a non-TCRβV-binding T cell engager"). In some embodiments, the anti-TCRβV antibodies disclosed herein result in expansion of TCRβV+ T cells, e.g., a subset of memory effector T cells known as $T_{EMRA}$. Without wishing to be bound by theory, it is believed that in some embodiments, $T_{EMRA}$ cells can promote tumor cell lysis but not CRS. Accordingly, provided herein are methods of making said anti-TCRβV antibody molecules and uses thereof. Also disclosed herein are multispecific molecules, e.g., bispecific molecules comprising said anti-TCRβV antibody molecules. In some embodiments, compositions comprising anti-TCRβV antibody molecules of the present disclosure, can be used, e.g., to: (1) activate and redirect T cells to promote tumor cell lysis for cancer immunotherapy; and/or (2) expand TCRβV+ T cells. In some embodiments, compositions comprising anti-TCRβV antibody molecules as disclosed herein limit the harmful side-effects of CRS and/or NT, e.g., CRS and/or NT associated with anti-CD3e targeting.

In some embodiments, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to a TCRβV region other than TCRβ V12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule does not comprise the CDRs of the Antibody B murine antibody.

In some embodiments, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule does not comprise the CDRs of the TM23 murine antibody.

Accordingly, provided herein are, inter alia, anti-TCRβV antibody molecules, multispecific or multifunctional molecules (e.g., multispecific or multifunctional antibody molecules) that comprise anti-TCRβV antibody molecules, nucleic acids encoding the same, methods of producing the aforesaid molecules, pharmaceutical compositions comprising aforesaid molecules, and methods of treating a disease or disorder, e.g., cancer, using the aforesaid molecules. The antibody molecules and pharmaceutical compositions disclosed herein can be used (alone or in combination with other agents or therapeutic modalities) to treat, prevent and/or diagnose disorders and conditions, e.g., cancer, e.g., as described herein.

Definitions

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "acquire" or "acquiring" as the terms are used herein, refer to obtaining possession of a physical entity (e.g., a sample, a polypeptide, a nucleic acid, or a sequence), or a value, e.g., a numerical value, by "directly acquiring" or "indirectly acquiring" the physical entity or value. "Directly acquiring" means performing a process (e.g., performing a synthetic or analytical method) to obtain the physical entity or value. "Indirectly acquiring" refers to receiving the physical entity or value from another party or source (e.g., a third party laboratory that directly acquired the physical entity or value). Directly acquiring a physical entity includes performing a process that includes a physical change in a physical substance, e.g., a starting material. Directly acquiring a value includes performing a process that includes a physical change in a sample or another substance, e.g., performing an analytical process which includes a physical change in a substance, e.g., a sample.

As used herein, the term "T cell receptor beta variable chain" or "TCRβV," refers to an extracellular region of the T cell receptor beta chain which comprises the antigen recognition domain of the T cell receptor. The term TCRβV includes isoforms, mammalian, e.g., human TCRβV, species homologs of human and analogs comprising at least one common epitope with TCRβV. Human TCRβV comprises a gene family comprising subfamilies including, but not limited to: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβV24 subfamily, a TCRβ V20 subfamily, TCRβ V25 subfamily, a TCRβ V29 subfamily, a TCRβV1 subfamily, a TCRβ V17 subfamily, a TCRβ V21 subfamily, a TCRβ V23 subfamily, or a TCRβ V26 subfamily, as well as family members of said subfamilies, and variants thereof (e.g., a structural or functional variant thereof). In some embodiments, the TCRβ V6 subfamily comprises: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, TCRβV comprises TCRβ V6-5*01, or a variant thereof, e.g., a variant having 85%, 90%, 95%, 99% or more identity the naturally-occurring sequence. TCRβ V6-5*01 is also known as TRBV65; TCRBV6S5; TCRBV13S1, or TCRβ V13.1. The amino acid sequence of TCRβ V6-5*01, e.g., human TCRβ V6-5*01, is known in that art, e.g., as provided by IMGT ID L36092. In some embodiments, TCRβ V6-5*01 is encoded by the nucleic acid sequence of SEQ ID NO: 43, or a sequence having 85%, 90%, 95%, 99% or more identity thereof. In some embodiments, TCRβ V6-5*01 comprises the amino acid sequence of SEQ ID NO: 44, or a sequence having 85%, 90%, 95%, 99% or more identity thereof.

The term "human-like antibody molecule" as used herein refers to a humanized antibody molecule, human antibody molecule or an antibody molecule having at least 95% identity with a non-murine germline framework region, e.g., FR1, FR2, FR3 and/or FR4. In some embodiments, the human-like antibody molecule comprises a framework region having at least 95% identity to a human germline framework region, e.g., a FR1, FR2, FR3 and/or FR4 of a human germline framework region. In some embodiments, the human-like antibody molecule is a recombinant antibody. In some embodiments, the human-like antibody molecule is a humanized antibody molecule. In some embodiments, the human-like antibody molecule is human antibody molecule. In some embodiments, the human-like antibody molecule is a phage display or a yeast display antibody molecule. In some embodiments, the human-like antibody molecule is a chimeric antibody molecule. In some embodiments, the human-like antibody molecule is a CDR grafted antibody molecule.

The term "cytokine profile" as used herein, refers to the level and/or activity of on one or more cytokines or chemokines, e.g., as described herein. In some embodiments, a cytokine profile comprises the level and/or activity of a naturally occurring cytokine, a fragment or a variant thereof. In an embodiment, a cytokine profile comprises the level and/or activity of one or more cytokines and/or one or more chemokines (e.g., as described herein). In some embodiments, a cytokine profile comprises the level and/or activity of a naturally occurring cytokine, a fragment or a variant thereof. In some embodiments, a cytokine profile comprises the level and/or activity of a naturally occurring chemokine, a fragment or a variant thereof. In an embodiment, a cytokine profile comprises the level and/or activity of one or more of: IL-2 (e.g., full length, a variant, or a fragment thereof); IL-1beta (e.g., full length, a variant, or a fragment thereof); IL-6 (e.g., full length, a variant, or a fragment thereof); TNFα (e.g., full length, a variant, or a fragment thereof); IFNg (e.g., full length, a variant, or a fragment thereof) IL-10 (e.g., full length, a variant, or a fragment thereof); IL-4 (e.g., full length, a variant, or a fragment thereof); TNF alpha (e.g., full length, a variant, or a fragment thereof); IL-12p70 (e.g., full length, a variant, or a fragment thereof); IL-13 (e.g., full length, a variant, or a fragment thereof); IL-8 (e.g., full length, a variant, or a fragment thereof); Eotaxin (e.g., full length, a variant, or a fragment thereof); Eotaxin-3 (e.g., full length, a variant, or a fragment thereof); IL-8 (HA) (e.g., full length, a variant, or a fragment thereof); IP-10 (e.g., full length, a variant, or a fragment thereof); MCP-1 (e.g., full length, a variant, or a fragment thereof); MCP-4 (e.g., full length, a variant, or a fragment thereof); MDC (e.g., full length, a variant, or a fragment thereof); MIP-1a (e.g., full length, a variant, or a fragment thereof); MIP-1b (e.g., full length, a variant, or a fragment thereof); TARC (e.g., full length, a variant, or a fragment thereof); GM-CSF (e.g., full length, a variant, or a fragment thereof); IL-12 23p40 (e.g., full length, a variant, or a fragment thereof); IL-15 (e.g., full length, a variant, or a fragment thereof); IL-16 (e.g., full length, a variant, or a fragment thereof); IL-17a (e.g., full length, a variant, or a fragment thereof); IL-1a (e.g., full length, a variant, or a fragment thereof); IL-5 (e.g., full length, a variant, or a fragment thereof); IL-7 (e.g., full length, a variant, or a fragment thereof); TNF-beta (e.g., full length, a variant, or a fragment thereof); or VEGF (e.g., full length, a variant, or a fragment thereof). In some embodiments, a cytokine profile includes secretion of one or more cytokines or chemokines.

In an embodiment, a cytokine in a cytokine profile can be modulated, e.g., increased or decreased, by an anti-TCRBV antibody molecule described herein. In one embodiment, the cytokine profile includes cytokines associated with a cytokine storm or cytokine release syndrome (CRS), e.g., IL-6, IL-1beta, TNFalpha and IL-10.

The term "variant" refers to a polypeptide that has a substantially identical amino acid sequence to the naturally-occurring sequence, or are encoded by a substantially identical nucleotide sequence. In some embodiments, the variant is a functional variant. In some embodiments, a TCRβV variant can bind to TCRα and form a TCR α:β complex.

The term "functional variant" refers to a polypeptide that has a substantially identical amino acid sequence to the naturally-occurring sequence, or are encoded by a substantially identical nucleotide sequence, and are capable of having one or more activities of the naturally-occurring sequence.

As used herein, a "multifunctional" or a "multispecific" molecule refers to molecule, e.g., a polypeptide, that has two or more functionalities, e.g., two or more binding specificities. In some embodiments, the functionalities can include one or more immune cell engagers, one or more tumor binding molecules, one or more cytokine molecules, one or more stromal modifiers, and other moieties described herein. In some embodiments, the multispecific molecule is a multispecific antibody molecule, e.g., a bispecific antibody molecule. In some embodiments, the multispecific molecule includes an anti-TCRVb antibody molecule as described herein.

In some embodiments, the multifunctional molecule includes an immune cell engager. "An immune cell engager" refers to one or more binding specificities that bind and/or activate an immune cell, e.g., a cell involved in an immune response. In embodiments, the immune cell is chosen from a T cell, an NK cell, a B cell, a dendritic cell, and/or the macrophage cell. The immune cell engager can be an antibody molecule, a receptor molecule (e.g., a full length receptor, receptor fragment, or fusion thereof (e.g., a receptor-Fc fusion)), or a ligand molecule (e.g., a full length ligand, ligand fragment, or fusion thereof (e.g., a ligand-Fc fusion)) that binds to the immune cell antigen (e.g., the T cell, the NK cell antigen, the B cell antigen, the dendritic cell antigen, and/or the macrophage cell antigen). In embodiments, the immune cell engager specifically binds to the target immune cell, e.g., binds preferentially to the target immune cell. For example, when the immune cell engager is an antibody molecule, it binds to an immune cell antigen (e.g., a T cell antigen, an NK cell antigen, a B cell antigen, a dendritic cell antigen, and/or a macrophage cell antigen) with a dissociation constant of less than about 10 nM.

In some embodiments, the multifunctional molecule includes a cytokine molecule. As used herein, a "cytokine molecule" refers to full length, a fragment or a variant of a cytokine; a cytokine further comprising a receptor domain, e.g., a cytokine receptor dimerizing domain; or an agonist of a cytokine receptor, e.g., an antibody molecule (e.g., an agonistic antibody) to a cytokine receptor, that elicits at least one activity of a naturally-occurring cytokine. In some embodiments the cytokine molecule is chosen from interleukin-2 (IL-2), interleukin-7 (IL-7), interleukin-12 (IL-12), interleukin-10 (IL-10), interleukin-15 (IL-15), interleukin-18 (IL-18), interleukin-21 (IL-21), or interferon gamma, or a fragment or variant thereof, or a combination of any of the aforesaid cytokines. The cytokine molecule can be a monomer or a dimer. In embodiments, the cytokine molecule can further include a cytokine receptor dimerizing domain. In other embodiments, the cytokine molecule is an agonist of a cytokine receptor, e.g., an antibody molecule (e.g., an agonistic antibody) to a cytokine receptor chosen from an IL-15Ra or IL-21R.

As used herein, the term "molecule" as used in, e.g., antibody molecule, cytokine molecule, receptor molecule, includes full-length, naturally-occurring molecules, as well as variants, e.g., functional variants (e.g., truncations, fragments, mutated (e.g., substantially similar sequences) or derivatized form thereof), so long as at least one function and/or activity of the unmodified (e.g., naturally-occurring) molecule remains.

In some embodiments, the multifunctional molecule includes a stromal modifying moiety. A "stromal modifying moiety," as used herein refers to an agent, e.g., a protein (e.g., an enzyme), that is capable of altering, e.g., degrading a component of, the stroma. In embodiments, the component of the stroma is chosen from, e.g., an ECM component, e.g., a glycosaminoglycan, e.g., hyaluronan (also known as hyaluronic acid or HA), chondroitin sulfate, chondroitin, dermatan sulfate, heparin sulfate, heparin, entactin, tenascin, aggrecan and keratin sulfate; or an extracellular protein, e.g., collagen, laminin, elastin, fibrinogen, fibronectin, and vitronectin.

Certain terms are defined below.

As used herein, the articles "a" and "an" refer to one or more than one, e.g., to at least one, of the grammatical object of the article. The use of the words "a" or "an" when used in conjunction with the term "comprising" herein may mean "one," but it is also consistent with the meaning of "one or more," "at least one," and "one or more than one."

As used herein, "about" and "approximately" generally mean an acceptable degree of error for the quantity measured given the nature or precision of the measurements. Exemplary degrees of error are within 20 percent (%), typically, within 10%, and more typically, within 5% of a given range of values.

"Antibody molecule" as used herein refers to a protein, e.g., an immunoglobulin chain or fragment thereof, comprising at least one immunoglobulin variable domain structure and/or sequence. An antibody molecule encompasses antibodies (e.g., full-length antibodies) and antibody fragments. In an embodiment, an antibody molecule comprises an antigen binding or functional fragment of a full length antibody, or a full length immunoglobulin chain. For example, a full-length antibody is an immunoglobulin (Ig) molecule (e.g., an IgG antibody) that is naturally occurring or formed by normal immunoglobulin gene fragment recombinatorial processes). In embodiments, an antibody molecule refers to an immunologically active, antigen-binding portion of an immunoglobulin molecule, such as an antibody fragment. An antibody fragment, e.g., functional fragment, is a portion of an antibody, e.g., Fab, Fab', F(ab')2, F(ab)$_2$, variable fragment (Fv), domain antibody (dAb), or single chain variable fragment (scFv). A functional antibody fragment binds to the same antigen as that recognized by the intact (e.g., full-length) antibody. The terms "antibody fragment" or "functional fragment" also include isolated fragments consisting of the variable regions, such as the "Fv" fragments consisting of the variable regions of the heavy and light chains or recombinant single chain polypeptide molecules in which light and heavy variable regions are connected by a peptide linker ("scFv proteins"). In some embodiments, an antibody fragment does not include portions of antibodies without antigen binding activity, such as Fc fragments or single amino acid residues. Exemplary antibody molecules include full length antibodies and antibody fragments, e.g., dAb (domain antibody), single chain, Fab, Fab', and F(ab')2 fragments, and single chain variable fragments (scFvs). In some embodiments, the antibody molecule is an antibody mimetic. In some embodiments, the antibody molecule is, or comprises, an antibody-like framework or scaffold, such as, fibronectins, ankyrin repeats (e.g., designed ankyrin repeat proteins (DARPins)), avimers, affibody affinity ligands, anticalins, or affilin molecules.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may or may not include one, two, or more N- or C-terminal amino acids, or may include other alterations that are compatible with formation of the protein structure.

In embodiments, an antibody molecule is monospecific, e.g., it comprises binding specificity for a single epitope. In some embodiments, an antibody molecule is multispecific, e.g., it comprises a plurality of immunoglobulin variable domain sequences, where a first immunoglobulin variable domain sequence has binding specificity for a first epitope and a second immunoglobulin variable domain sequence has binding specificity for a second epitope. In some embodiments, an antibody molecule is a bispecific antibody molecule. "Bispecific antibody molecule" as used herein refers to an antibody molecule that has specificity for more than one (e.g., two, three, four, or more) epitope and/or antigen.

"Antigen" (Ag) as used herein refers to a molecule that can provoke an immune response, e.g., involving activation of certain immune cells and/or antibody generation. Any macromolecule, including almost all proteins or peptides, can be an antigen. Antigens can also be derived from genomic recombinant or DNA. For example, any DNA comprising a nucleotide sequence or a partial nucleotide sequence that encodes a protein capable of eliciting an immune response encodes an "antigen." In embodiments, an antigen does not need to be encoded solely by a full length nucleotide sequence of a gene, nor does an antigen need to be encoded by a gene at all. In embodiments, an antigen can be synthesized or can be derived from a biological sample, e.g., a tissue sample, a tumor sample, a cell, or a fluid with other biological components. As used, herein a "tumor antigen" or interchangeably, a "cancer antigen" includes any molecule present on, or associated with, a cancer, e.g., a cancer cell or a tumor microenvironment that can provoke an immune response. As used, herein an "immune cell antigen" includes any molecule present on, or associated with, an immune cell that can provoke an immune response.

The "antigen-binding site," or "binding portion" of an antibody molecule refers to the part of an antibody molecule, e.g., an immunoglobulin (Ig) molecule, that participates in antigen binding. In embodiments, the antigen binding site is formed by amino acid residues of the variable (V) regions of the heavy (H) and light (L) chains. Three highly divergent stretches within the variable regions of the heavy and light chains, referred to as hypervariable regions, are disposed between more conserved flanking stretches called "framework regions," (FRs). FRs are amino acid sequences that are naturally found between, and adjacent to, hypervariable regions in immunoglobulins. In embodiments, in an antibody molecule, the three hypervariable regions of a light chain and the three hypervariable regions of a heavy chain are disposed relative to each other in three dimensional space to form an antigen-binding surface, which is complementary to the three-dimensional surface of a bound antigen. The three hypervariable regions of each of the heavy and light chains are referred to as "complementarity-determining regions," or "CDRs." The framework region and CDRs have been defined and described, e.g., in Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917. Each variable chain (e.g., variable heavy chain and variable light chain) is typically made up of three CDRs and four FRs, arranged from amino-terminus to carboxy-terminus in the amino acid order: FR1, CDR1, FR2, CDR2, FR3, CDR3, and FR4.

"Cancer" as used herein can encompass all types of oncogenic processes and/or cancerous growths. In embodiments, cancer includes primary tumors as well as metastatic tissues or malignantly transformed cells, tissues, or organs. In embodiments, cancer encompasses all histopathologies and stages, e.g., stages of invasiveness/severity, of a cancer. In embodiments, cancer includes relapsed and/or resistant cancer. The terms "cancer" and "tumor" can be used interchangeably. For example, both terms encompass solid and liquid tumors. As used herein, the term "cancer" or "tumor" includes premalignant, as well as malignant cancers and tumors.

As used herein, an "immune cell" refers to any of various cells that function in the immune system, e.g., to protect against agents of infection and foreign matter. In embodiments, this term includes leukocytes, e.g., neutrophils, eosinophils, basophils, lymphocytes, and monocytes. Innate leukocytes include phagocytes (e.g., macrophages, neutrophils, and dendritic cells), mast cells, eosinophils, basophils, and natural killer cells. Innate leukocytes identify and eliminate pathogens, either by attacking larger pathogens through contact or by engulfing and then killing microorganisms, and are mediators in the activation of an adaptive immune response. The cells of the adaptive immune system are special types of leukocytes, called lymphocytes. B cells and T cells are important types of lymphocytes and are derived from hematopoietic stem cells in the bone marrow. B cells are involved in the humoral immune response, whereas T cells are involved in cell-mediated immune response. The term "immune cell" includes immune effector cells.

"Immune effector cell," as that term is used herein, refers to a cell that is involved in an immune response, e.g., in the promotion of an immune effector response. Examples of immune effector cells include, but are not limited to, T cells, e.g., alpha/beta T cells and gamma/delta T cells, B cells, natural killer (NK) cells, natural killer T (NK T) cells, and mast cells.

The term "effector function" or "effector response" refers to a specialized function of a cell. Effector function of a T cell, for example, may be cytolytic activity or helper activity including the secretion of cytokines.

The compositions and methods of the present invention encompass polypeptides and nucleic acids having the sequences specified, or sequences substantially identical or similar thereto, e.g., sequences at least 80%, 85%, 90%, 95% identical or higher to the sequence specified. In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 80%, 85%, 90%. 91%, 92%, 93%, 94%, 95%, 96%, 97%, 98% or 99% identity to a reference sequence, e.g., a sequence provided herein.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 80%, 85%, 90%, 91%, 92%, 93%, 94%, 95%, 96%, 97%, 98% or 99% identity to a reference sequence, e.g., a sequence provided herein.

The term "variant" refers to a polypeptide that has a substantially identical amino acid sequence to a reference amino acid sequence, or is encoded by a substantially identical nucleotide sequence. In some embodiments, the variant is a functional variant.

The term "functional variant" refers to a polypeptide that has a substantially identical amino acid sequence to a reference amino acid sequence, or is encoded by a substantially identical nucleotide sequence, and is capable of having one or more activities of the reference amino acid sequence.

Calculations of homology or sequence identity between sequences (the terms are used interchangeably herein) are performed as follows.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology").

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch ((1970) *J. Mol. Biol.* 48:444-453) algorithm which has been incorporated into the GAP program in the GCG software package (available at website: gcg.com), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available at website: gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215: 403-10. BLAST nucleotide searches can be performed with the NBLAST program, score=100, wordlength=12 to obtain nucleotide sequences homologous to a nucleic acid molecule of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (1997) *Nucleic Acids Res.* 25:3389-3402. When utilizing BLAST and Gapped BLAST programs, the default parameters of the respective programs (e.g., XBLAST and NBLAST) can be used.

It is understood that the molecules of the present invention may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof; amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

The terms "polypeptide", "peptide" and "protein" (if single chain) are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The terms "nucleic acid," "nucleic acid sequence," "nucleotide sequence," or "polynucleotide sequence," and "polynucleotide" are used interchangeably. They refer to a polymeric form of nucleotides of any length, either deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

The term "isolated," as used herein, refers to material that is removed from its original or native environment (e.g., the natural environment if it is naturally occurring). For example, a naturally-occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

Various aspects of the invention are described in further detail below. Additional definitions are set out throughout the specification.

Human T Cell Receptor (TCR) Complex

T cell receptors (TCR) can be found on the surface of T cells. TCRs recognize antigens, e.g., peptides, presented on, e.g., bound to, major histocompatibility complex (MHC) molecules on the surface of cells, e.g., antigen-presenting cells. TCRs are heterodimeric molecules and can comprise an alpha chain, a beta chain, a gamma chain or a delta chain. TCRs comprising an alpha chain and a beta chain are also referred to as TCRαβ. The TCR beta chain consists of the following regions (also known as segments): variable (V), diversity (D), joining (J) and constant (C) (see Mayer G. and Nyland J. (2010) Chapter 10: Major Histocompatibility Complex and T-cell Receptors-Role in Immune Responses. In: Microbiology and Immunology on-line, University of South Carolina School of Medicine). The TCR alpha chain consists of V, J and C regions. The rearrangement of the T-cell receptor (TCR) through somatic recombination of V (variable), D (diversity), J (joining), and C (constant) regions is a defining event in the development and maturation of a T cell. TCR gene rearrangement takes place in the thymus.

TCRs can comprise a receptor complex, known as the TCR complex, which comprises a TCR heterodimer comprising of an alpha chain and a beta chain, and dimeric signaling molecules, e.g., CD3 co-receptors, e.g., CD3δ/ε, and/or CD3γ/ε.

TCR beta V (TCRβV)

Diversity in the immune system enables protection against a huge array of pathogens. Since the germline genome is limited in size, diversity is achieved not only by the process of V(D)J recombination but also by junctional (junctions between V-D and D-J segments) deletion of nucleotides and addition of pseudo-random, non-templated nucleotides. The TCR beta gene undergoes gene arrangement to generate diversity.

The TCR V beta repertoire varies between individuals and populations because of, e.g., 7 frequently occurring inactivating polymorphisms in functional gene segments and a large insertion/deletion-related polymorphism encompassing 2 V beta gene segments.

This disclosure provides, inter alia, antibody molecules and fragments thereof, that bind, e.g., specifically bind, to a human TCR beta V chain (TCRβV), e.g., a TCRβV gene family (also referred to as a group), e.g., a TCRβV subfamily (also referred to as a subgroup), e.g., as described herein. TCR beta V families and subfamilies are known in the art, e.g., as described in Yassai et al., (2009) *Immunogenetics* 61(7)pp: 493-502; Wei S. and Concannon P. (1994) *Human Immunology* 41(3) pp: 201-206. The antibodies described herein can be recombinant antibodies, e.g., recombinant non-murine antibodies, e.g., recombinant human or humanized antibodies.

In an aspect, the disclosure provides an anti-TCRβV antibody molecule that binds to human TCRβV, e.g., a TCRβV family, e.g., gene family or a variant thereof. In some embodiments a TCRBV gene family comprises one or more subfamilies, e.g., as described herein, e.g., in FIG. 3, Table 8A or Table 8B. In some embodiments, the TCRβV gene family comprises: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβV24 subfamily, a TCRβ V20 subfamily, TCRβ V25 subfamily, a TCRβ V29 subfamily, a TCRβV1 subfamily, a TCRβ V17 subfamily, a TCRβ V21 subfamily, a TCRβ V23 subfamily, or a TCRβ V26 subfamily.

In some embodiments, TCRβ V6 subfamily is also known as TCRβ V13.1. In some embodiments, the TCRβ V6 subfamily comprises: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβV6-3*01 or TCRβ V6-1*01, or a variant thereof. In some embodiments, TCRβ V6 comprises TCRβ V6-4*01, or a variant thereof. In some embodiments, TCRβ V6 comprises TCRβ V6-4*02, or a variant thereof. In some embodiments, TCRβ V6 comprises TCRβ V6-9*01, or a variant thereof. In some embodiments, TCRβ V6 comprises TCRβ V6-8*01, or a variant thereof. In some embodiments, TCRβ V6 comprises TCRβ V6-5*01, or a variant thereof. In some embodiments, TCRβ V6 comprises TCRβ V6-6*02, or a variant thereof. In some embodiments, TCRβ V6 comprises TCRβ V6-6*01, or a variant thereof. In some embodiments, TCRβ V6 comprises TCRβ V6-2*01, or a variant thereof. In some embodiments, TCRβ V6 comprises TCRβ V6-3*01, or a variant thereof. In some embodiments, TCRβ V6 comprises TCRβ V6-1*01, or a variant thereof.

In some embodiments, TCRβ V6 comprises TCRβ V6-5*01, or a variant thereof. In some embodiments, TCRβ V6, e.g., TCRβ V6-5*01, is recognized, e.g., bound, by SEQ ID NO: 1 and/or SEQ ID NO: 2. In some embodiments, TCRβ V6, e.g., TCRβ V6-5*01, is recognized, e.g., bound, by SEQ ID NO: 9 and/or SEQ ID NO: 10. In some embodiments, TCRβ V6 is recognized, e.g., bound, by SEQ ID NO: 9 and/or SEQ ID NO: 11.

In some embodiments, TCRβ V10 subfamily is also known as TCRβ V12. In some embodiments, the TCRβ V10 subfamily comprises: TCRβ V10-1*01, TCRβ V10-1*02, TCRβV10-3*01 or TCRβ V10-2*01, or a variant thereof.

In some embodiments, TCRβ V12 subfamily is also known as TCRβ V8.1. In some embodiments, the TCRβ V12 subfamily comprises: TCRβ V12-4*01, TCRβ V12-3*01, or TCRβV12-5*01, or a variant thereof. In some embodiments, TCRβ V12 is recognized, e.g., bound, by SEQ ID NO: 15 and/or SEQ ID NO: 16. In some embodiments, TCRβ V12 is recognized, e.g., bound, by any one of SEQ ID NOs 23-25, and/or any one of SEQ ID NO: 26-30:

In some embodiments, the TCRβ V5 subfamily is chosen from: TCRβ V5-5*01, TCRβV5-6*01, TCRβ V5-4*01, TCRβ V5-8*01, TCRβ V5-1*01, or a variant thereof.

In some embodiments, the TCRβ V7 subfamily comprises TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01, or a variant thereof.

In some embodiments, the TCRβ V11 subfamily comprises: TCRβ V11-1*01, TCRβV11-2*01 or TCRβ V11-3*01, or a variant thereof.

In some embodiments, the TCRβ V14 subfamily comprises TCRβ V14*01, or a variant thereof.

In some embodiments, the TCRβ V16 subfamily comprises TCRβ V16*01, or a variant thereof.

In some embodiments, the TCRβ V18 subfamily comprises TCRβ V18*01, or a variant thereof.

In some embodiments, the TCRβ V9 subfamily comprises TCRβ V9*01 or TCRβ V9*02, or a variant thereof.

In some embodiments, the TCRβ V13 subfamily comprises TCRβ V13*01, or a variant thereof.

In some embodiments, the TCRβ V4 subfamily comprises TCRβ V4-2*01, TCRβ V4-3*01, or TCRβ V4-1*01, or a variant thereof.

In some embodiments, the TCRβ V3 subfamily comprises TCRβ V3-1*01, or a variant thereof.

In some embodiments, the TCRβ V2 subfamily comprises TCRβ V2*01, or a variant thereof.

In some embodiments, the TCRβ V15 subfamily comprises TCRβ V15*01, or a variant thereof.

In some embodiments, the TCRβ V30 subfamily comprises TCRβ V30*01, or TCRβV30*02, or a variant thereof.

In some embodiments, the TCRβ V19 subfamily comprises TCRβ V19*01, or TCRβV19*02, or a variant thereof.

In some embodiments, the TCRβ V27 subfamily comprises TCRβ V27*01, or a variant thereof.

In some embodiments, the TCRβ V28 subfamily comprises TCRβ V28*01, or a variant thereof.

In some embodiments, the TCRβ V24 subfamily comprises TCRβ V24-1*01, or a variant thereof.

In some embodiments, the TCRβ V20 subfamily comprises TCRβ V20-1*01, or TCRβV20-1*02, or a variant thereof.

In some embodiments, the TCRβ V25 subfamily comprises TCRβ V25-1*01, or a variant thereof.

In some embodiments, the TCRβ V29 subfamily comprises TCRβ V29-1*01, or a variant thereof.

TABLE 8A

List of TCRβV subfamilies and subfamily members

| Reference in FIG. 3 | Subfamily | Subfamily members |
|---|---|---|
| A | TCRβ V6 Also referred to as: TCR VB 13.1 | TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. |
| B | TCRβ V10 Also referred to as: TCRβ V12 | TCRβ V10-1*01, TCRβ V10-1*02, TCRβ V10-3*01 or TCRβ V10-2*01 |
| C | TCRβ V12 Also referred to as: TCRβ V8.1 | TCRβ V12-4*01, TCRβ V12-3*01, or TCRβ V12-5*01 |
| D | TCRβ V5 | TCRβ V5-5*01, TCRβ V5-6*01, TCRβ V5-4*01, TCRβ V5-8*01, TCRβ V5-1*01 |
| E | TCRβ V7 | TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01 |

TABLE 8A-continued

List of TCRβV subfamilies and subfamily members

| Reference in FIG. 3 | Subfamily | Subfamily members |
|---|---|---|
| F | TCRβ V11 | TCRβ V11-1*01, TCRβ V11-2*01 or TCRβ V11-3*01 |
| G | TCRβ V14 | TCRβ V14*01 |
| H | TCRβ V16 | TCRβ V16*01 |
| I | TCRβ V18 | TCRβ V18*01 |
| J | TCRβ V9 | TCRβ V9*01 or TCRβ V9*02 |
| K | TCRβ V13 | TCRβ V13*01 |
| L | TCRβ V4 | TCRβ V4-2*01, TCRβ V4-3*01, or TCRβ V4-1*01 |
| M | TCRβ V3 | TCRβ V3-1*01 |
| N | TCRβ V2 | TCRβ V2*01 |
| O | TCRβ V15 | TCRβ V15*01 |
| P | TCRβ V30 | TCRβ V30*01, or TCRβ V30*02 |
| Q | TCRβ V19 | TCRβ V19*01, or TCRβ V19*02 |
| R | TCRβ V27 | TCRβ V27*01. |
| S | TCRβ V28 | TCRβ V28*01. |
| T | TCRβ V24 | TCRβ V24-1*01 |
| U | TCRβ V20 | TCRβ V20-1*01, or TCRβ V20-1*02 |
| V | TCRβ V25 | TCRβ V25-1*01 |
| W | TCRβ V29 | TCRβ V29-1*01 |

TABLE 8B

Additional TCRβV subfamilies

| Subfamily |
|---|
| TCRβ V1 |
| TCRβ V17 |
| TCRβ V21 |
| TCRβ V23 |
| TCRβ V26 |

Exemplary amino acid sequences for TCRβV subfamily members can be found on the ImMunoGeneTics Information System website: imgt.org/, or in a similar resource.

The alignment of TCRBV amino acid sequences in Table 9 underscores the diversity of TCR sequences. In particular, the TRBV sequences from different subfamilies are considerably different from each other.

Anti-TCRβV Antibodies

Disclosed herein, is the discovery of a novel class of antibodies, i.e. anti-TCRβV antibody molecules disclosed herein, which despite having low sequence similarity (e.g., low sequence identity among the different antibody molecules that recognize different TCRβV subfamilies), recognize a structurally conserved region, e.g., domain, on the TCRβV protein (e.g., as denoted by the circled area in FIG. 24A) and have a similar function (e.g., a similar cytokine profile). Thus, the anti-TCRβV antibody molecules disclosed herein share a structure-function relationship.

Without wishing to be bound by theory, it is believed that in some embodiments, the anti-TCRβV antibody molecules disclosed herein bind to an outward facing epitope of a TCRβV protein when it is in a complex with a TCRalpha protein, e.g., as described by the circled area in FIG. 24A. In some embodiments, the anti-TCRβV antibody molecules disclosed herein recognize (e.g., bind to), a structurally conserved domain on the TCRβV protein (e.g., as denoted by the circled area in FIG. 24A).

In some embodiments, the anti-TCRβV antibody molecules disclosed herein do not recognize, e.g., bind to, an interface of a TCRβV:TCRalpha complex.

In some embodiments, the anti-TCRβV antibody molecules disclosed herein do not recognize, e.g., bind to, a constant region of a TCRβV protein. An exemplary antibody that binds to a constant region of a TCRBV region is JOVI.1 as described in Viney et al., (Hybridoma. 1992 December; 11(6):701-13).

In some embodiments, the anti-TCRβV antibody molecules disclosed herein do not recognize, e.g., bind to, one or more (e.g., all) of a complementarity determining region (e.g., CDR1, CDR2 and/or CDR3) of a TCRβV protein.

In some embodiments, the anti-TCRβV antibody molecules disclosed herein binds (e.g., specifically binds) to a TCRβV region. In some embodiments, binding of anti-TCRβV antibody molecules disclosed herein results in a cytokine profile that differs from a cytokine profile of a T cell engager that binds to a receptor or molecule other than a TCRβV region ("a non-TCRβV-binding T cell engager"). In some embodiments, the non-TCRβV-binding T cell engager comprises an antibody that binds to a CD3 molecule (e.g., CD3 epsilon (CD3e) molecule); or a TCR alpha (TCRα) molecule. In some embodiments, the non-TCRβV-binding T cell engager is an OKT3 antibody or an SP34-2 antibody.

In an aspect, the disclosure provides an anti-TCRβV antibody molecule that binds to human TCRβV, e.g., a TCRβV gene family, e.g., one or more of a TCRβV subfamily, e.g., as described herein, e.g., in FIG. 3, Table 8A, or Table 8B. In some embodiments, the anti-TCRβV antibody molecule binds to one or more TCRβV subfamilies chosen from: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβV3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, a TCRβ V29 subfamily, a TCRβ V1 subfamily, a TCRβ V17 subfamily, a TCRβ V21 subfamily, a TCRβ V23 subfamily, or a TCRβ V26 subfamily, or a variant thereof.

In some embodiments, the anti-TCRβV antibody molecule binds to a TCRβ V6 subfamily comprising: TCRβ V6-4*01, TCRβ V6-4*02, TCRβ V6-9*01, TCRβ V6-8*01, TCRβV6-5*01, TCRβ V6-6*02, TCRβ V6-6*01, TCRβ V6-2*01, TCRβ V6-3*01 or TCRβ V6-1*01, or a variant thereof. In some embodiments the TCRβ V6 subfamily comprises TCRβ V6-5*01, or a variant thereof. In some embodiments, TCRβ V6 comprises TCRβ V6-4*01, or a variant thereof. In some embodiments, TCRβ V6 comprises TCRβ V6-4*02, or a variant thereof. In some embodiments, TCRβ V6 comprises TCRβ V6-9*01, or a variant thereof. In some embodiments, TCRβ V6 comprises TCRβ V6-8*01, or a variant thereof. In some embodiments, TCRβ V6 comprises TCRβ V6-5*01, or a variant thereof. In some embodiments, TCRβ V6 comprises TCRβ V6-6*02, or a variant thereof. In some embodiments, TCRβ V6 comprises TCRβ V6-6*01, or a variant thereof. In some embodiments, TCRβ V6 comprises TCRβ V6-2*01, or a variant thereof. In some embodiments, TCRβ V6 comprises TCRβ V6-3*01, or a variant thereof. In some embodiments, TCRβ V6 comprises TCRβ V6-1*01, or a variant thereof.

In some embodiments, the anti-TCRβV antibody molecule binds to a TCRβ V10 subfamily comprising: TCRβ V10-101, TCRβ V 10-1*02, TCRβ V 10-3*01 or TCRβ V 10-2*01, or a variant thereof.

In some embodiments, the anti-TCRβV antibody molecule binds to a TCRβ V12 subfamily comprising: TCRβ V12-4*01, TCRβ V12-3*01 or TCRβ V12-5*01, or a variant thereof.

In some embodiments, the anti-TCRβV antibody molecule binds to a TCRβ V5 subfamily comprising: TCRβ V5-5*01, TCRβ V5-6*01, TCRβ V5-4*01, TCRβ V5-8*01, TCRβV5-1*01, or a variant thereof.

Exemplary anti-TCRβV antibody molecules and the corresponding TCRβV subfamily recognized by said anti-TCRβV antibody molecules is disclosed in Table 13.

TABLE 13

Exemplary anti-TCRBV antibody molecules

| TRBV name gene | TRBV allele name | Reagents monoclonal antibodies | | |
|---|---|---|---|---|
| | | Clone name and Specificity | Company product | Isotype |
| TRBV2 | TRBV2*01 | IsMMU 546 (TRBV2) | Serotec V BETA 22 | Mouse |
| | TRBV2*02 | | Coulter Vbeta22 | IgG1 |
| | TRBV2*03 | | | |
| TRBV3-1 | TRBV3-1*01 | FIN9 (TRBV3-1) | Serotec Vbeta9 | Mouse |
| | | | Coulter Vbeta9 | IgG2a |
| | TRBV3-1*02 | AMKB1-2 (TRBV3-1) | BD Biosciences Vbeta9 | Mouse IgG1 |
| TRBV4-1 | TRBV4-1*01 | ZOE (TRBV4-1, TRBV4-2, TRBV4-3) | Serotec V BETA 7 Coulter Vbeta7 | Mouse IgG2a |
| | TRBV4-1*02 | 3G5 (TRBV4-1) | Pierce Endogen V beta 7.1 | Mouse IgG2b |
| TRBV4-2 | TRBV4-2*01 | ZOE (TRBV4-1, TRBV4-2, TRBV4-3) | Serotec V BETA 7 Coulter Vbeta7 | Mouse IgG2a |
| | TRBV4-2*02 | | | |
| TRBV4-3 | TRBV4-3*01 | ZOE (TRBV4-1, TRBV4-2, TRBV4-3) | Serotec V BETA 7 Coulter Vbeta7 | Mouse IgG2a |
| | TRBV4-3*02 | | | |
| | TRBV4-3*03 | | | |
| | TRBV4-3*04 | ZIZOU4 (TRBV4-3) | Coulter Vbeta7.2 | Mouse IgG2a |
| TRBV5-1 | TRBV5-1*01 | IMMU157 (TRBV5-1) | Serotec Vbeta5.1 Coulter Vbeta5.1 | Mouse IgG2a |
| | TRBV5-1*02 | LC4 (TRBV5-1) | Pierce Endogen V beta 5(c) BD Biosciences Vbeta5(c) | Mouse IgG1 |
| TRBV5-4 | TRBV5-4*01 | | | |
| | TRBV5-4*02 | | | |
| | TRBV5-4*03 | | | |
| | TRBV5-4*04 | | | |
| TRBV5-5 | TRBV5-5*01 | 3D11 (TRBV5-5) | Serotec VBETA5.3 Coulter Vbeta5.3 | Mouse IgG1 |
| | TRBV5-5*02 | 1C1 (TRBV5-5, TRBV5-6) | Pierce Endogen V beta 5(a) BD Biosciences Vbeta5(a) | Mouse IgG1 |
| | TRBV5-5*03 | W112 (TRBV5-5) | Pierce Endogen V beta 5(b) Serotec V beta 5.2/5.3 | Mouse IgG1 |
| | | MH3-2 (TRBV5-5, TRBV5-6) | BD Biosciences Vbeta5(b) | |
| | | | BD Biosciences Vbeta5 | Mouse IgG2a |
| | | 4H11 (TM27) as disclosed in U.S. Pat. No. 5,861,155 | | |
| TRBV5-6 | TRBV5-6*01 | 36213 (TRBV5-6) | Serotec Vbeta5.2 | Mouse IgG1 |
| | | 1C1 (TRBV5-5, TRBV5-6) | BD Biosciences Vbeta5(a) | |
| | | MH3-2 (TRBV5-5, TRBV5-6) | BD Biosciences Vbeta5 | Mouse IgG1 Mouse IgG2a |
| TRBV5-8 | TRBV5-8*01 | | | |
| | TRBV5-8*02 | | | |
| TRBV6-1 | TRBV6-1*01 | BAM13 (TRBV6-1, TRBV6-5) | Pierce Endogen V beta 13 BD Biosciences Vbeta 13.1, 13.3 | Mouse IgG1 |
| TRBV6-2 | TRBV6-2*01 | H132 | Coulter Vbeta 13.2 | Mouse IgG1 |
| TRBV6-3 | TRBV6-3*01 | | | |
| TRBV6-4 | TRBV6-4*01 | | | |
| | TRBV6-4*02 | | | |

TABLE 13-continued

Exemplary anti-TCRBV antibody molecules

| TRBV name gene | TRBV allele name | Reagents monoclonal antibodies | | |
|---|---|---|---|---|
| | | Clone name and Specificity | Company product | Isotype |
| TRBV6-5 | TRBV6-5*01 | IMMU 222 (TRBV6-5, TRBV6-6 and TRBV6-9) | Serotec V BETA 13.1 Coulter Vbeta 13.1 Pierce Endogen V beta 13 | Mouse IgG2b Mouse IgG1 |
| | | BAM13 (TRBV6-1, TRBV6-5) | BD Biosciences Vbeta13.1, 13.3 | |
| TRBV6-6 | TRBV6-6*01 TRBV6-6*02 TRBV6-6*03 TRBV6-6*04 TRBV6-6*05 | JU-74 (TRBV6-6) JU74.3 (TRBV6-6) | Serotec Vbeta13.6 Coulter Vbeta13.6 | Mouse IgG1 |
| | | IMMU 222 (TRBV6-5, TRBV6-6 and TRBV6-9) | Serotec V BETA 13.1 Coulter Vbeta 13.1 | Mouse IgG2b |
| TRBV6-8 | TRBV6-8*01 | | | |
| TRBV6-9 | TRBV6-9*01 | IMMU 222 (TRBV6-5, TRBV6-6 and TRBV6-9) | Serotec V BETA 13.1 Coulter Vbeta 13.1 | Mouse IgG2b |
| TRBV7-2 | TRBV7-2*01 TRBV7-2*02 TRBV7-2*03 TRBV7-2*04 | OT145 (TRBV7-2) | Pierce Endogen V beta 6.7 BD Biosciences Vbeta6.7 | Mouse IgG1 |
| TRBV7-3 | TRBV7-3*01 TRBV7-3*04 TRBV7-3*05 | | | |
| TRBV7-4 | TRBV7-4*01 | | | |
| TRBV7-6 | TRBV7-6*01 TRBV7-6*02 | | | |
| TRBV7-7 | TRBV7-7*01 TRBV7-7*02 | | | |
| TRBV7-8 | TRBV7-8*01 TRBV7-8*02 TRBV7-8*03 | | | |
| TRBV7-9 | TRBV7-9*01 TRBV7-9*02 TRBV7-9*03 TRVB7-9*04 TRBV7-9*05 TRBV7-9*06 TRBV7-9*07 | | | |
| TRBV9 | TRBV9*01 TRBV9*02 TRBV9*03 | BL37.2 (TRBV9) | Serotec Vbeta1 Coulter Vbeta1 | Rat IgG1 |
| TRBV10-1 | TRBV10-1*01 TRBV10-1*02 | S511 (TRBV10-1, TRBV10-2, TRBV10-3) | Pierce Endogen V beta 12 | Mouse IgG2b |
| TRBV10-2 | TRBV10-2*01 TRBV10-2*02 | | BD Biosciences Vbeta 12 | |
| TRBV10-3 | TRBV10-3*01 TRBV10-3*02 TRBV10-3*03 TRBV10-3*04 | VER2.32.1 (TRBV10-3) S511 (TRBV10-1, TRBV10-2, TRBV10-3) | Serotec Vbeta 12 Coulter Vbeta 12 Pierce Endogen V beta 12 BD Biosciences Vbeta 12 | Mouse IgG2a Mouse IgG2b |
| TRBV11-1 | TRBV11-1*01 | | | |
| TRBV11-2 | TRBV11-2*01 TRBV11-2*02 TRBV11-2*03 | IG125 (TRBV11-2) | Serotec Vbeta21.3 Coulter Vbeta21.3 | Mouse IgG2a |
| TRBV11-3 | TRBV11-3*01 TRBV11-3*02 TRBV11-3*03 TRBV11-3*04 | | | |
| TRBV12-3 | TRBV12-3*01 | 56C5 (TRBV12-3, TRBV12-4) | Serotec Vbeta8.1/8.2 Coulter Vbeta8 | Mouse IgG2a |
| TRBV12-4 | TRBV12-4*01 TRBV12-4*02 | 56C5.2 (TRBV12-3, TRBV12-4) 16G8 (TRBV12-3, TRBV12-4) MX-6 (TRBV12-3, TRBV12-4) JR2 (TRBV12-3, TRBV12-4, TRBV12-5) | Pierce Endogen V beta 8(a) BD Biosciences Vbeta8 Pierce Endogen V beta 8(b) BD Biosciences Vbeta8 | Mouse IgG2b Mouse IgG2a Mouse IgG2b |
| TRBV12-5 | TRBV12-5*01 | JR2 (TRBV12-3, TRBV12-4, TRBV12-5) | BD Biosciences Vbeta8 | Mouse IgG2b |
| TRBV13 | TRBV13*01 TRBV13*02 | AF-23 (TRBV13) AF23 (TRBV13) AHUT7 (Vbeta23) | Serotec Vbeta23 Coulter Vbeta23 BD Biosciences Vbeta23 | Mouse IgG1 |

TABLE 13-continued

Exemplary anti-TCRBV antibody molecules

| TRBV name gene | TRBV allele name | Clone name and Specificity | Reagents monoclonal antibodies Company product | Isotype |
|---|---|---|---|---|
| TRBV14 | TRBV14*01 | TAMAYA1.2 (TRBV14) | Serotec Vbeta16 | Mouse |
|  | TRBV14*02 |  | Coulter Vbeta16 | IgG1 |
| TRBV15 | TRBV15*01 |  |  |  |
|  | TRBV15*02 |  |  |  |
|  | TRBV15*03 |  |  |  |
| TRBV16 | TRBV16*01 |  |  |  |
|  | TRBV16*03 |  |  |  |
| TRBV18 | TRBV18*01 | BA62 (TRBV18) | Serotec V BETA 18 | Mouse |
|  |  | BA62.6 (TRBV18) | Coulter Vbeta 18 | IgG1 |
| TRBV19 | TRBV19*01 | C1 (TRBV19) | Pierce Endogen V beta 17 | Mouse IgG1 |
|  |  |  | BD Biosciences Vbeta 17 |  |
|  | TRBV19*02 | E17.5F3 (TRBV19) | Serotec Vbeta 17 | Mouse |
|  | TRBV19*03 | E17.5F3.15.13 (TRBV19) | Coulter Vbeta 17 | IgG1 |
| TRBV20-1 | TRBV20-1*01 | MPB2D5 (TRBV20-1) | Serotec VBETA2 | Mouse |
|  | TRBV20-1*02 |  | Coulter Vbeta2 | IgG1 |
|  | TRBV20-1*03 |  |  |  |
|  | TRBV20-1*04 |  |  |  |
|  | TRBV20-1*05 |  |  |  |
|  | TRBV20-1*06 |  |  |  |
|  | TRBV20-1*07 |  |  |  |
| TRBV24-1 | TRBV24-1*01 |  |  |  |
| TRBV25-1 | TRBV25-1*01 | C21 (TRBV25-1) | Serotec V BETA 11 | Mouse |
|  |  |  | Coulter Vbeta11 | IgG2a |
| TRBV27 | TRBV27*01 | CAS1.1.3 (TRBV27) | Serotec Vbeta14 | Mouse |
|  |  |  | Coulter Vbeta14 | IgG1 |
| TRBV28 | TRBV28*01 | CH92 (TRBV28) | Serotec Vbeta3 | Mouse |
|  |  |  | Coulter Vbeta3 | IgM |
|  |  | 8F10 (TRBV28) | Pierce Endogen V beta 3.1 | Mouse IgG1 |
|  |  | JOVI-3 (TRBV28) | BD Biosciences Vbeta3 | Mouse IgG2a |
| TRBV29-1 | TRBV29-1*01 | WJF24 | Coulter Vbeta4 | Rat IgM |
|  | TRBV29-1*02 |  |  |  |
|  | TRBV29-1*03 |  |  |  |
| TRBV30 | TRBV30*01 | ELL1.4 (TRBV30) | Serotec Vbeta20 | Mouse |
|  | TRBV30*02 |  | Coulter Vbeta20 | IgG1 |
|  | TRBV30*04 |  |  |  |
|  | TRBV30*05 |  |  |  |

In some embodiments, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to a TCRβV region other than TCRβ V12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

Anti-TCRβ V6 Antibodies

Accordingly, in one aspect, the disclosure provides an anti-TCRβV antibody molecule that binds to human TCRβ V6, e.g., a TCRβ V6 subfamily comprising: TCRβ V6-4*01, TCRβV6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments the TCRβ V6 subfamily comprises TCRβ V6-5*01 or a variant thereof. In some embodiments, TCRβ V6 comprises TCRβ V6-4*01, or a variant thereof. In some embodiments, TCRβ V6 comprises TCRβ V6-4*02, or a variant thereof. In some embodiments, TCRβ V6 comprises TCRβ V6-9*01, or a variant thereof. In some embodiments, TCRβ V6 comprises TCRβ V6-8*01, or a variant thereof. In some embodiments, TCRβ V6 comprises TCRβ V6-5*01, or a variant thereof. In some embodiments, TCRβ V6 comprises TCRβ V6-6*02, or a variant thereof. In some embodiments, TCRβ V6 comprises TCRβ V6-6*01, or a variant thereof. In some embodiments, TCRβ V6 comprises TCRβ V6-2*01, or a variant thereof. In some embodiments, TCRβ V6 comprises TCRβ V6-3*01, or a variant thereof. In some embodiments, TCRβ V6 comprises TCRβ V6-1*01, or a variant thereof.

In some embodiments, TCRβ V6-5*01 is encoded by the nucleic acid sequence of SEQ ID NO: 43, or a sequence having 85%, 90%, 95%, 99% or more identity thereof.
SEQ ID NO: 43
ATGAGCATCGGCCTCCTGTGCTGTGCAGCCTTGTCTCTCCTGTGGGCAGGTCCAGTG AATGCTGGTGTCACTCAGACCCCAAAATTCCAGGTCCTGAAGACAGGACAGAGCAT GACACTGCAGTGTGCCCAGGATATGAACCATGAATACATGTCCTGGTATCGACAAG ACCCAGGCATGGGGCTGAGGCTGATTCATTACTCAGTTGGTGCTGGTATCACTGACC AAGGAGAAGTCCCCAATGGCTACAATGTCTCCAGATCAACCACAGAGGATTTCCCG CTCAGGCTGCTGTCGGCTGCTCCCTCCCAGACATCTGTGTACTTCTGTGCCAGCAGTT ACTC In some embodiments, TCRβ V6-5*01 comprises the amino acid sequence of SEQ ID NO: 44, or an amino acid sequence having 85%, 90%, 95%, 99% or more identity thereof.
SEQ ID NO: 44
MSIGLLCCAALSLLWAGPVNAGVTQTPKFQVLKTGQSMTLQCAQDMNHEYMSWYRQ DPGMGLRLIHYSVGAGITDQGEVPNGYNVSRSTTEDFPLRLLSAAPSQTSVYFCASSY In some embodiments, the anti-TCRβV antibody molecule, e.g., anti-TCRβ V6 (e.g., anti-TCRβ V6-5*01) antibody molecule, is a non-murine antibody molecule, e.g., a human or humanized antibody molecule. In some embodiments, the anti-TCRβV antibody molecule, e.g., anti-TCRβ V6 (e.g., anti-TCRβ V6-5*01) antibody molecule is a human antibody molecule. In some embodiments, the anti-TCRβV antibody molecule, e.g., anti-TCRβ V6 (e.g., anti-TCRβV6-5*01) antibody molecule is a humanized antibody molecule.

In some embodiments, the anti-TCRβV antibody molecule, e.g., anti-TCRβ V6 (e.g., anti-TCRβ V6-5*01) antibody molecule, is isolated or recombinant.

In some embodiments, the anti-TCRβV antibody molecule, e.g., anti-TCRβ V6 (e.g., anti-TCRβ V6-5*01) antibody molecule, comprises at least one antigen-binding region, e.g., a variable region or an antigen-binding fragment thereof, from an antibody described herein, e.g., an antibody chosen from A-H.1 or A-H.2, or an antibody described in Table 1, or encoded by a nucleotide sequence in Table 1, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one, two, three or four variable regions from an antibody described herein, e.g., an antibody chosen from A-H.1 or A-H.2, or an antibody described in Table 1, or encoded by a nucleotide sequence in Table 1, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one or two heavy chain variable regions from an antibody described herein, e.g., an antibody chosen from A-H.1 or A-H.2, or an antibody molecule described in Table 1, or encoded by a nucleotide sequence in Table 1, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule comprises a heavy chain variable region (VH) having a consensus sequence of SEQ ID NO: 231 or 3290.

In some embodiments, the anti-TCRβV antibody molecule, e.g., anti-TCRβ V6 (e.g., anti-TCRβ V6-5*01) antibody molecule, comprises at least one or two light chain variable regions from an antibody described herein, e.g., an antibody chosen from A-H.1 or A-H.2, or an antibody described in Table 1, or encoded by a nucleotide sequence in Table 1, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule comprises a light chain variable region (VL) having a consensus sequence of SEQ ID NO: 230 or 3289.

In some embodiments, the anti-TCRβV antibody molecule, e.g., anti-TCRβ V6 (e.g., anti-TCRβ V6-5*01) antibody molecule, comprises a heavy chain constant region for an IgG4, e.g., a human IgG4. In still another embodiment, the anti-TCRβV antibody molecule, e.g., anti-TCRβ V6 (e.g., anti-TCRβ V6-5*01) antibody molecule includes a heavy chain constant region for an IgG1, e.g., a human IgG1. In one embodiment, the heavy chain constant region comprises an amino sequence set forth in Table 3, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V6 (e.g., anti-TCRβ V6-5*01) antibody molecule, includes a kappa light chain constant region, e.g., a human kappa light chain constant region. In one embodiment, the light chain constant region comprises an amino sequence set forth in Table 3, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V6 (e.g., anti-TCRβ V6-5*01) antibody molecule, includes at least one, two, or three complementarity determining regions (CDRs) from a heavy chain variable region (VH) of an antibody described herein, e.g., an antibody chosen from A-H.1 or A-H.2, or an antibody described in Table 1, or encoded by a nucleotide sequence in Table 1, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, includes at least one, two, or three CDRs (or collectively all of the CDRs) from a heavy chain variable region comprising an amino acid sequence shown in Table 1, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In some embodiments, the anti-TCRβV antibody molecule, e.g., anti-TCRβ V6 (e.g., anti-TCRβ V6-5*01) antibody molecule, includes at least one, two, or three complementarity determining regions (CDRs) from a light chain variable region of an antibody described herein, e.g., an antibody chosen from A-H.1 or A-H.2, or an antibody described in Table 1, or encoded by a nucleotide sequence in Table 1, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, includes at least one, two, or three CDRs (or collectively all of the CDRs) from a light chain variable region comprising an amino acid sequence shown in Table 1, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In some embodiments, the anti-TCRβV antibody molecule, e.g., anti-TCRβ V6 (e.g., anti-TCRβ V6-5*01) antibody molecule, includes at least one, two, three, four, five or six CDRs (or collectively all of the CDRs) from a heavy and light chain variable region comprising an amino acid sequence shown in Table 1, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In some embodiments, the anti-TCRβV antibody molecule, e.g., anti-TCRβ V6 (e.g., anti-TCRβ V6-5*01) antibody molecule, molecule includes all six CDRs from an antibody described herein, e.g., an antibody chosen from A-H.1 or A-H.2, or an antibody described in Table 1, or encoded by a nucleotide sequence in Table 1, or closely related CDRs, e.g., CDRs which are identical or which have at least one amino acid alteration, but not more than two, three or four alterations (e.g., substitutions, deletions, or insertions, e.g., conservative substitutions). In some embodiments, the anti-TCRβV antibody molecule, e.g., anti-TCRβ V6 (e.g., anti-TCRβV6-5*01) antibody molecule, may include any CDR described herein.

In some embodiments, the anti-TCRβV antibody molecule, e.g., anti-TCRβ V6 (e.g., anti-TCRβ V6-5*01) antibody molecule includes at least one, two, or three CDRs according to Kabat et al. (e.g., at least one, two, or three CDRs according to the Kabat definition as set out in Table 1) from a heavy chain variable region of an antibody described herein, e.g., an antibody chosen from A-H.1 or A-H.2, or an antibody described in Table 1, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 1.

In some embodiments, the anti-TCRβV antibody molecule, e.g., anti-TCRβ V6 (e.g., anti-TCRβ V6-5*01) antibody molecule includes at least one, two, or three CDRs according to Kabat et al. (e.g., at least one, two, or three CDRs according to the Kabat definition as set out in Table 1) from a light chain variable region of an antibody described herein, e.g., an antibody chosen from A-H.1 or A-H.2, or an antibody described in Table 1, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 1.

In some embodiments, the anti-TCRβV antibody molecule, e.g., anti-TCRβ V6 (e.g., anti-TCRβ V6-5*01) antibody molecule, includes at least one, two, three, four, five, or six CDRs according to Kabat et al. (e.g., at least one, two, three, four, five, or six CDRs according to the Kabat definition as set out in Table 1) from the heavy and light chain variable regions of an antibody described herein, e.g., an antibody chosen from A-H.1 or A-H.2, or an antibody described in Table 1, or encoded by a nucleotide sequence in Table 1; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Kabat et al. shown in Table 1.

In some embodiments, the anti-TCRβV antibody molecule, e.g., anti-TCRβ V6 (e.g., anti-TCRβ V6-5*01) antibody molecule, includes all six CDRs according to Kabat et al. (e.g., all six CDRs according to the Kabat definition as set out in Table 1) from the heavy and light chain variable regions of an antibody described herein, e.g., an antibody chosen from A-H.1 or A-H.2, or an antibody described in Table 1, or encoded by a nucleotide sequence in Table 1; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Kabat et al. shown in Table 1. In one embodiment, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule, includes at least one, two, or three hypervariable loops that have the same canonical structures as the corresponding hypervariable loop of an antibody described herein, e.g., an antibody chosen from chosen from A-H.1 or A-H.2 e.g., the same canonical structures as at least loop 1 and/or loop 2 of the heavy and/or light chain variable domains of an antibody described herein. See, e.g., Chothia et al., (1992) J. Mol. Biol. 227:799-817; Tomlinson et al., (1992) J. Mol. Biol. 227:776-798 for descriptions of hypervariable loop canonical structures. These structures can be determined by inspection of the tables described in these references.

In some embodiments, the anti-TCRβV antibody molecule, e.g., anti-TCRβ V6 (e.g., anti-TCRβ V6-5*01) antibody molecule includes at least one, two, or three CDRs according to Chothia et al. (e.g., at least one, two, or three CDRs according to the Chothia definition as set out in Table 1) from a heavy chain variable region of an antibody described herein, e.g., an antibody chosen from A-H.1 or A-H.2, or as described in Table 1, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 1 In some embodiments, the anti-TCRβV antibody molecule, e.g., anti-TCRβ V6 (e.g., anti-TCRβ V6-5*01) antibody molecule includes at least one, two, or three CDRs according to Chothia et al. (e.g., at least one, two, or three CDRs according to the Chothia definition as set out in Table 1) from a light chain variable region of an antibody described herein, e.g., an antibody chosen from A-H.1 or A-H.2, or an antibody described in Table 1, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 1.

In some embodiments, the anti-TCRβV antibody molecule, e.g., anti-TCRβ V6 (e.g., anti-TCRβ V6-5*01) antibody molecule, includes at least one, two, three, four, five, or six CDRs according to Chothia et al. (e.g., at least one, two, three, four, five, or six CDRs according to the Chothia definition as set out in Table 1) from the heavy and light chain variable regions of an antibody described herein, e.g., an antibody chosen from A-H.1 or A-H.2, or an antibody described in Table 1, or encoded by the nucleotide sequence in Table 1; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Chothia et al. shown in Table 1.

In some embodiments, the anti-TCRβV antibody molecule, e.g., anti-TCRβ V6 (e.g., anti-TCRβ V6-5*01) antibody molecule, includes all six CDRs according to Chothia et al. (e.g., all six CDRs according to the Chothia definition as set out in Table 1) from the heavy and light chain variable regions of an antibody described herein, e.g., an antibody chosen from A-H.1 or A-H.2, or an antibody described in Table 1, or encoded by a nucleotide sequence in Table 1; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations, e.g., substitutions, deletions, or insertions, e.g., conservative substitutions) relative to all six CDRs according to Chothia et al. shown in Table 1. In one embodiment, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule, molecule includes a combination of CDRs or hypervariable loops defined according to Kabat et al., Chothia et al., or as described in Table 1.

In some embodiments, the anti-TCRβV antibody molecule, e.g., anti-TCRβ V6 (e.g., anti-TCRβ V6-5*01) antibody molecule, can contain any combination of CDRs or hypervariable loops according to the Kabat and Chothia definitions.

In some embodiments, a combined CDR as set out in Table 1 is a CDR that comprises a Kabat CDR and a Chothia CDR.

In some embodiments, the anti-TCRβV antibody molecule, e.g., anti-TCRβ V6 (e.g., anti-TCRβ V6-5*01) antibody molecule, molecule includes a combination of CDRs or hypervariable loops identified as combined CDRs in Table 1. In some embodiments, the anti-TCRβV antibody molecule, e.g., anti-TCRβ V6 (e.g., anti-TCRβ V6-5*01) antibody molecule, can contain any combination of CDRs or hypervariable loops according the "combined" CDRs are described in Table 1.

In an embodiment, e.g., an embodiment comprising a variable region, a CDR (e.g., a combined CDR, Chothia CDR or Kabat CDR), or other sequence referred to herein, e.g., in Table 1, the antibody molecule is a monospecific antibody molecule, a bispecific antibody molecule, a bivalent antibody molecule, a biparatopic antibody molecule, or an antibody molecule that comprises an antigen binding fragment of an antibody, e.g., a half antibody or antigen binding fragment of a half antibody. In certain embodiments the antibody molecule comprises a multispecific molecule, e.g., a bispecific molecule, e.g., as described herein.

In an embodiment, the anti-TCRβV antibody molecule, e.g., anti-TCRβ V6 (e.g., anti-TCRβ V6-5*01) antibody molecule includes:
(i) one, two or all of a light chain complementarity determining region 1 (LC CDR1), a light chain complementarity determining region 2 (LC CDR2), and a light chain complementarity determining region 3 (LC CDR3) of SEQ ID NO: 2, SEQ ID NO: 10 or SEQ ID NO: 11, and/or
(ii) one, two or all of a heavy chain complementarity determining region 1 (HC CDR1), heavy chain complementarity determining region 2 (HC CDR2), and a heavy chain complementarity determining region 3 (HC CDR3) of SEQ ID NO: 1 or SEQ ID NO: 9.

In some embodiments, the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 2, and a HC CDR1, HC CDR2, and HC CDR3 of SEQ ID NO: 1.

In some embodiments the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 10, and a HC CDR1, HC CDR2, and HC CDR3 of SEQ ID NO: 9.

In some embodiments, the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 11, and a HC CDR1, HC CDR2, and HC CDR3 of SEQ ID NO: 9.

In an embodiment, the anti-TCRβV antibody molecule, e.g., anti-TCRβ V6 (e.g., anti-TCRβ V6-5*01) antibody molecule comprises:
(i) a LC CDR1 amino acid sequence of SEQ ID NO: 6, a LC CDR2 amino acid sequence of SEQ ID NO: 7, or a LC CDR3 amino acid sequence of SEQ ID NO: 8; and/or
(ii) a HC CDR1 amino acid sequence of SEQ ID NO: 3, a HC CDR2 amino acid sequence of SEQ ID NO: 4, or a HC CDR3 amino acid sequence of SEQ ID NO: 5.

In some embodiments, the anti-TCRβV antibody molecule, e.g., anti-TCRβ V6 (e.g., anti-TCRβ V6-5*01) antibody molecule comprises:
(i) a light chain variable region (VL) comprising a LC CDR1 amino acid sequence of SEQ ID NO: 6, a LC CDR2 amino acid sequence of SEQ ID NO: 7, or a LC CDR3 amino acid sequence of SEQ ID NO: 8; and/or
(ii) a heavy chain variable region (VH) comprising a HC CDR1 amino acid sequence of SEQ ID NO: 3, a HC CDR2 amino acid sequence of SEQ ID NO: 4, or a HC CDR3 amino acid sequence of SEQ ID NO: 5.

In an embodiment, the anti-TCRβV antibody molecule, e.g., anti-TCRβ V6 (e.g., anti-TCRβ V6-5*01) antibody molecule comprises:
(i) a LC CDR1 amino acid sequence of SEQ ID NO: 51, a LC CDR2 amino acid sequence of SEQ ID NO: 52, or a LC CDR3 amino acid sequence of SEQ ID NO: 53; and/or
(ii) a HC CDR1 amino acid sequence of SEQ ID NO: 45, a HC CDR2 amino acid sequence of SEQ ID NO: 46, or a HC CDR3 amino acid sequence of SEQ ID NO: 47.

In some embodiments, the anti-TCRβV antibody molecule, e.g., anti-TCRβ V6 (e.g., anti-TCRβ V6-5*01) antibody molecule comprises:
(i) a light chain variable region (VL) comprising a LC CDR1 amino acid sequence of SEQ ID NO: 51, a LC CDR2 amino acid sequence of SEQ ID NO: 52, or a LC CDR3 amino acid sequence of SEQ ID NO: 53; and/or
(ii) a heavy chain variable region (VH) comprising a HC CDR1 amino acid sequence of SEQ ID NO: 45, a HC CDR2 amino acid sequence of SEQ ID NO: 46, or a HC CDR3 amino acid sequence of SEQ ID NO: 47.

In an embodiment, the anti-TCRβV antibody molecule, e.g., anti-TCRβ V6 (e.g., anti-TCRβ V6-5*01) antibody molecule comprises:
(i) a LC CDR1 amino acid sequence of SEQ ID NO: 54, a LC CDR2 amino acid sequence of SEQ ID NO: 55, or a LC CDR3 amino acid sequence of SEQ ID NO: 56; and/or
(ii) a HC CDR1 amino acid sequence of SEQ ID NO: 48, a HC CDR2 amino acid sequence of SEQ ID NO: 49, or a HC CDR3 amino acid sequence of SEQ ID NO: 50.

In some embodiments, the anti-TCRβV antibody molecule, e.g., anti-TCRβ V6 (e.g., anti-TCRβ V6-5*01) antibody molecule comprises:
(i) a light chain variable region (VL) comprising a LC CDR1 amino acid sequence of SEQ ID NO: 54, a LC CDR2 amino acid sequence of SEQ ID NO: 55, or a LC CDR3 amino acid sequence of SEQ ID NO: 56; and/or
(ii) a heavy chain variable region (VH) comprising a HC CDR1 amino acid sequence of SEQ ID NO: 48, a HC CDR2 amino acid sequence of SEQ ID NO: 49, or a HC CDR3 amino acid sequence of SEQ ID NO: 50.

In one embodiment, the light or the heavy chain variable framework (e.g., the region encompassing at least FR1, FR2, FR3, and optionally FR4) of the anti-TCRβV antibody molecule, e.g., anti-TCRβ V6 (e.g., anti-TCRβ V6-5*01) antibody molecule can be chosen from: (a) a light or heavy chain variable framework including at least 80%, 85%, 87% 90%, 92%, 93%, 95%, 97%, 98%, or 100% of the amino acid residues from a human light or heavy chain variable framework, e.g., a light or heavy chain variable framework residue from a human mature antibody, a human germline sequence, or a human consensus sequence; (b) a light or heavy chain variable framework including from 20% to 80%, 40% to 60%, 60% to 90%, or 70% to 95% of the amino acid residues from a human light or heavy chain variable framework, e.g., a light or heavy chain variable framework residue from a human mature antibody, a human germline sequence, or a human consensus sequence; (c) a non-human framework (e.g., a rodent framework); or (d) a non-human framework that has been modified, e.g., to remove antigenic or cytotoxic determinants, e.g., deimmunized, or partially humanized. In one embodiment, the light or heavy chain variable framework region (particularly FR1, FR2 and/or FR3) includes a light or heavy chain variable framework sequence at least 70, 75, 80, 85, 87, 88, 90, 92, 94, 95, 96, 97, 98, 99% identical or identical to the frameworks of a VL or VH segment of a human germline gene.

In some embodiments, the anti-TCRβV antibody molecule, e.g., anti-TCRβ V6 (e.g., anti-TCRβ V6-5*01) antibody molecule, comprises a heavy chain variable domain having at least one, two, three, four, five, six, seven, ten, fifteen, twenty or more changes, e.g., amino acid substitutions or deletions, from an amino acid sequence of A-H.1 or A-H.2, e.g., the amino acid sequence of the FR region in the entire variable region, e.g., shown in FIG. 1A, or in SEQ ID NO: 9.

Alternatively, or in combination with the heavy chain substitutions described herein, the anti-TCRβV antibody molecule, e.g., anti-TCRβ V6 (e.g., anti-TCRβ V6-5*01) antibody molecule, comprises a light chain variable domain having at least one, two, three, four, five, six, seven, ten, fifteen, twenty or more amino acid changes, e.g., amino acid substitutions or deletions, from an amino acid sequence of A-H.1 or A-H.2 e.g., the amino acid sequence of the FR region in the entire variable region, e.g., shown in FIG. 1B, or in SEQ ID NO: 10 or SEQ ID NO: 11.

In some embodiments, the anti-TCRβV antibody molecule, e.g., anti-TCRβ V6 (e.g., anti-TCRβ V6-5*01) antibody molecule, includes one, two, three, or four heavy chain framework regions shown in FIG. 1A, or a sequence substantially identical thereto.

In some embodiments, the anti-TCRβV antibody molecule, e.g., anti-TCRβ V6 (e.g., anti-TCRβ V6-5*01) antibody molecule, includes one, two, three, or four light chain framework regions shown in FIG. 1B, or a sequence substantially identical thereto.

In some embodiments, the anti-TCRβV antibody molecule, e.g., anti-TCRβ V6 (e.g., anti-TCRβ V6-5*01) antibody molecule, comprises the light chain framework region 1 of A-H.1 or A-H.2, e.g., as shown in FIG. 1B.

In some embodiments, the anti-TCRβV antibody molecule, e.g., anti-TCRβ V6 (e.g., anti-TCRβ V6-5*01) antibody molecule, comprises the light chain framework region 2 of A-H.1 or A-H.2, e.g., as shown in FIG. 1B.

In some embodiments, the anti-TCRβV antibody molecule, e.g., anti-TCRβ V6 (e.g., anti-TCRβ V6-5*01) antibody molecule, comprises the light chain framework region 3 of A-H.1 or A-H.2, e.g., as shown in FIG. 1B.

In some embodiments, the anti-TCRβV antibody molecule, e.g., anti-TCRβ V6 (e.g., anti-TCRβ V6-5*01) antibody molecule, comprises the light chain framework region 4 of A-H.1 or A-H.2, e.g., as shown in FIG. 1B.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 1 (FR1), comprising a change, e.g., a substitution (e.g., a conservative substitution) at position 10 according to Kabat numbering. In some embodiments, the FR1 comprises a Phenylalanine at position 10, e.g., a Serine to Phenylalanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 2 (FR2), comprising a change, e.g., a substitution (e.g., a conservative substitution) at a position disclosed herein according to Kabat numbering. In some embodiments, FR2 comprises a Histidine at position 36, e.g., a substitution at position 36 according to Kabat numbering, e.g., a Tyrosine to Histidine substitution. In some embodiments, FR2 comprises an Alanine at position 46, e.g., a substitution at position 46 according to Kabat numbering, e.g., an Arginine to Alanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 3 (FR3), comprising a change, e.g., a substitution (e.g., a conservative substitution) at a position disclosed herein according to Kabat numbering. In some embodiments, FR3 comprises a Phenylalanine at position 87, e.g., a substitution at position 87 according to Kabat numbering, e.g., a Tyrosine to Phenylalanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 1 (FR1) comprising a Phenylalanine at position 10, e.g., a substitution at position 10 according to Kabat numbering, e.g., a Serine to Phenylalanine substitution; (b) a framework region 2 (FR2) comprising a Histidine at position 36, e.g., a substitution at position 36 according to Kabat numbering, e.g., a Tyrosine to Histidine substitution, and a Alanine at position 46, e.g., a substitution at position 46 according to Kabat numbering, e.g., a Arginine to Alanine substitution; and (c) a framework region 3 (FR3) comprising a Phenylalanine at position 87, e.g., a substitution at position 87 according to Kabat numbering, e.g., a Tyrosine to Phenylalanine substitution, e.g., as shown in the amino acid sequence of SEQ ID NO: 10. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 2 (FR2) comprising a Histidine at position 36, e.g., a substitution at position 36 according to Kabat numbering, e.g., a Tyrosine to Histidine substitution, and a Alanine at position 46, e.g., a substitution at position 46 according to Kabat numbering, e.g., a Arginine to Alanine substitution; and (b) a framework region 3 (FR3) comprising a Phenylalanine at position 87, e.g., a substitution at position 87 according to Kabat numbering, e.g., a Tyrosine to Phenylalanine substitution, e.g., as shown in the amino acid sequence of SEQ ID NO: 11. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 1 (FR1) comprising a change, e.g., a substitution (e.g., a conservative substitution) at one or more (e.g., all) positions disclosed herein according to Kabat numbering; (b) a framework region 2 (FR2) comprising a change, e.g., a substitution (e.g., a conservative substitution) at one or more (e.g., all) position disclosed herein according to Kabat numbering and (c) a framework region 3 (FR3) comprising a change, e.g., a substitution (e.g., a conservative substitution) at one or more (e.g., all) position disclosed herein according to Kabat numbering.

In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises the heavy chain framework region 1 of A-H.1 or A-H.2, e.g., as shown in FIG. 1A.

In some embodiments, the anti-TCRβV antibody molecule, e.g., anti-TCRβ V6 (e.g., anti-TCRβ V6-5*01) antibody molecule, comprises the heavy chain framework region 2 of A H.1 or A-H.2, e.g., as shown in FIG. 1A In some embodiments, the anti-TCRβV antibody molecule, e.g., anti-TCRβ V6 (e.g., anti-TCRβ V6-5*01) antibody molecule, comprises the heavy chain framework region 3 of A-H.1 or A-H.2, e.g., as shown in FIG. 1A.

In some embodiments, the anti-TCRβV antibody molecule, e.g., anti-TCRβ V6 (e.g., anti-TCRβ V6-5*01) antibody molecule, comprises the heavy chain framework region 4 of A-H.1 or A-H.2, e.g., as shown in FIG. 1A.

In some embodiments, the anti-TCRβV antibody molecule, e.g., anti-TCRβ V6 (e.g., anti-TCRβ V6-5*01) antibody molecule, comprises a heavy chain variable domain comprising a framework region, e.g., framework region 3 (FR3), comprising a change, e.g., a substitution (e.g., a conservative substitution) at a position disclosed herein according to Kabat numbering. In some embodiments, FR3 comprises a Threonine at position 73, e.g., a substitution at position 73 according to Kabat numbering, e.g., a Glutamic Acid to Threonine substitution. In some embodiments, FR3 comprises a Glycine at position 94, e.g., a substitution at position 94 according to Kabat numbering, e.g., an Arginine to Glycine substitution. In some embodiments, the substitution is relative to a human germline heavy chain framework region sequence.

In some embodiments, the anti-TCRβV antibody molecule, e.g., anti-TCRβ V6 (e.g., anti-TCRβ V6-5*01) antibody molecule, comprises a heavy chain variable domain comprising a framework region 3 (FR3) comprising a Threonine at position 73, e.g., a substitution at position 73 according to Kabat numbering, e.g., a Glutamic Acid to Threonine substitution, and a Glycine at position 94, e.g., a substitution at position 94 according to Kabat numbering, e.g., a Arginine to Glycine substitution, e.g., as shown in the amino acid sequence of SEQ ID NO: 10.

In some embodiments, the anti-TCRβV antibody molecule, e.g., anti-TCRβ V6 (e.g., anti-TCRβ V6-5*01) antibody molecule, comprises the heavy chain framework regions 1-4 of A-H.1 or A-H.2, e.g., SEQ ID NO: 9, or as shown in FIGS. 1A and 1B.

In some embodiments, the anti-TCRβV antibody molecule, e.g., anti-TCRβ V6 (e.g., anti-TCRβ V6-5*01) antibody molecule, comprises the light chain framework regions 1-4 of A-H.1, e.g., SEQ ID NO: 10, or as shown in FIGS. 1A and 1B.

In some embodiments, the anti-TCRβV antibody molecule, e.g., anti-TCRβ V6 (e.g., anti-TCRβ V6-5*01) antibody molecule, comprises the light chain framework regions 1-4 of A-H.2, e.g., SEQ ID NO: 11, or as shown in FIGS. 1A and 1B.

In some embodiments, the anti-TCRβV antibody molecule, e.g., anti-TCRβ V6 (e.g., anti-TCRβ V6-5*01) antibody molecule, comprises the heavy chain framework regions 1-4 of A-H.1, e.g., SEQ ID NO: 9; and the light chain framework regions 1-4 of A-H.1, e.g., SEQ ID NO: 10, or as shown in FIGS. 1A and 1B.

In some embodiments, the anti-TCRβV antibody molecule, e.g., anti-TCRβ V6 (e.g., anti-TCRβ V6-5*01) antibody molecule, comprises the heavy chain framework regions 1-4 of A-H.2, e.g., SEQ ID NO: 9; and the light chain framework regions 1-4 of A-H.2, e.g., SEQ ID NO: 11, or as shown in FIGS. 1A and 1B.

In some embodiments, the heavy or light chain variable domain, or both, of the anti-TCRβV antibody molecule, e.g., anti-TCRβ V6 (e.g., anti-TCRβ V6-5*01) antibody molecule, includes an amino acid sequence, which is substantially identical to an amino acid disclosed herein, e.g., at least 80%, 85%, 90%, 92%, 95%, 97%, 98%, 99% or higher identical to a variable region of an antibody described herein, e.g., an antibody chosen from A-H.1 or A-H.2, or as described in Table 1, or encoded by the nucleotide sequence in Table 1; or which differs at least 1 or 5 residues, but less than 40, 30, 20, or 10 residues, from a variable region of an antibody described herein.

In some embodiments, the anti-TCRβV antibody molecule, e.g., anti-TCRβ V6 (e.g., anti-TCRβ V6-5*01) antibody molecule, comprises at least one, two, three, or four antigen-binding regions, e.g., variable regions, having an amino acid sequence as set forth in Table 1, or a sequence substantially identical thereto (e.g., a sequence at least about 85%, 90%, 95%, 99% or more identical thereto, or which differs by no more than 1, 2, 5, 10, or 15 amino acid residues from the sequences shown in Table 1. In another embodiment, the anti-TCRβV antibody molecule, e.g., anti-TCRβ V6 (e.g., anti-TCRβ V6-5*01) antibody molecule includes a VH and/or VL domain encoded by a nucleic acid having a nucleotide sequence as set forth in Table 1, or a sequence substantially identical thereto (e.g., a sequence at least about 85%, 90%, 95%, 99% or more identical thereto, or which differs by no more than 3, 6, 15, 30, or 45 nucleotides from the sequences shown in Table 1.

In some embodiments, the anti-TCRβV antibody molecule, e.g., anti-TCRβ V6 (e.g., anti-TCRβ V6-5*01) antibody molecule, comprises:
a VH domain comprising the amino acid sequence of SEQ ID NO: 9, an amino acid sequence at least about 85%, 90%, 95%, 99% or more identical to the amino acid sequence of SEQ ID NO: 9, or an amino acid sequence which differs by no more than 1, 2, 5, 10, or 15 amino acid residues from the amino acid sequence of SEQ ID NO: 9; and/or
a VL domain comprising the amino acid sequence of SEQ ID NO: 10, an amino acid sequence at least about 85%, 90%, 95%, 99% or more identical to the amino acid sequence of SEQ ID NO: 10, or an amino acid sequence which differs by no more than 1, 2, 5, 10, or 15 amino acid residues from the amino acid sequence of SEQ ID NO: 10.

In some embodiments, the anti-TCRβV antibody molecule, e.g., anti-TCRβ V6 (e.g., anti-TCRβ V6-5*01) antibody molecule, comprises:
a VH domain comprising the amino acid sequence of SEQ ID NO: 9, an amino acid sequence at least about 85%, 90%, 95%, 99% or more identical to the amino acid sequence of SEQ ID NO: 9, or an amino acid sequence which differs by no more than 1, 2, 5, 10, or 15 amino acid residues from the amino acid sequence of SEQ ID NO: 9; and/or
a VL domain comprising the amino acid sequence of SEQ ID NO: 11, an amino acid sequence at least about 85%, 90%, 95%, 99% or more identical to the amino acid sequence of SEQ ID NO: 11, or an amino acid sequence which differs by no more than 1, 2, 5, 10, or 15 amino acid residues from the amino acid sequence of SEQ ID NO: 11.

In some embodiments, the anti-TCRβV antibody molecule, e.g., anti-TCRβ V6 (e.g., anti-TCRβ V6-5*01) antibody molecule is a full antibody or fragment thereof (e.g., a Fab, F(ab')2, Fv, or a single chain Fv fragment (scFv)). In embodiments, the anti-TCRβV antibody molecule, e.g., anti-TCRβ V6 (e.g., anti-TCRβ V6-5*01) antibody molecule is a monoclonal antibody or an antibody with single specificity. In some embodiments, the anti-TCRβV antibody molecule, e.g., anti-TCRβ V6 (e.g., anti-TCRβ V6-5*01) antibody molecule, can also be a humanized, chimeric, camelid, shark, or an in vitro-generated antibody molecule. In some embodiments, the anti-TCRβV antibody molecule, e.g., anti-TCRβ V6 (e.g., anti-TCRβ V6-5*01) antibody molecule, is a humanized antibody molecule. The heavy and light chains of the anti-TCRβV antibody molecule, e.g., anti-TCRβ V6 (e.g., anti-TCRβ V6-5*01) antibody molecule, can be full-length (e.g., an antibody can include at least one, and preferably two, complete heavy chains, and at least one, and preferably two, complete light chains) or can include an antigen-binding fragment (e.g., a Fab, F(ab')2, Fv, a single chain Fv fragment, a single domain antibody, a diabody (dAb), a bivalent antibody, or bispecific antibody or fragment thereof, a single domain variant thereof, or a camelid antibody).

In some embodiments, the anti-TCRβV antibody molecule, e.g., anti-TCRβ V6 (e.g., anti-TCRβ V6-5*01) antibody molecule, is in the form of a multispecific molecule, e.g., a bispecific molecule, e.g., as described herein.

In some embodiments, the anti-TCRβV antibody molecule, e.g., anti-TCRβ V6 (e.g., anti-TCRβ V6-5*01) antibody molecule, has a heavy chain constant region (Fc) chosen from, e.g., the heavy chain constant regions of IgG1, IgG2, IgG3, IgG4, IgM, IgA1, IgA2, IgD, and IgE. In some embodiments, the Fc region is chosen from the heavy chain constant regions of IgG1, IgG2, IgG3, and IgG4. In some embodiments, the Fc region is chosen from the heavy chain constant region of IgG1 or IgG2 (e.g., human IgG1, or IgG2). In some embodiments, the heavy chain constant region is human IgG1.

In some embodiments, the anti-TCRβV antibody molecule, e.g., anti-TCRβ V6 (e.g., anti-TCRβ V6-5*01) antibody molecule, has a light chain constant region chosen from, e.g., the light chain constant regions of kappa or lambda, preferably kappa (e.g., human kappa). In one embodiment, the constant region is altered, e.g., mutated, to modify the properties of the anti-TCRβV antibody molecule, e.g., anti-TCRβ V6 (e.g., anti-TCRβ V6-5*01) antibody molecule (e.g., to increase or decrease one or more of: Fc receptor binding, antibody glycosylation, the number of cysteine residues, effector cell function, or complement function). For example, the constant region is mutated at positions 296 (M to Y), 298 (S to T), 300 (T to E), 477 (H to K) and 478 (N to F) to alter Fc receptor binding (e.g., the mutated positions correspond to positions 132 (M to Y), 134 (S to T), 136 (T to E), 313 (H to K) and 314 (N to F) of SEQ ID NOs: 212 or 214; or positions 135 (M to Y), 137 (5 to T), 139 (T to E), 316 (H to K) and 317 (N to F) of SEQ ID NOs: 215, 216, 217 or 218), e.g., relative to human IgG1.

Antibody A-H.1 comprises a heavy chain comprising the amino acid sequence of SEQ ID NO: 3278 and a light chain comprising the amino acid sequence of SEQ ID NO: 72.

Antibody A-H.2 comprises a heavy chain comprising the amino acid sequence of SEQ ID NO: 3278 and a light chain comprising the amino acid sequence of SEQ ID NO: 3279.

Table 1: Amino acid and nucleotide sequences for murine, chimeric and humanized antibody molecules. The antibody molecules include murine mAb Antibody A, and humanized mAb Antibody A-H Clones A-H.1 and A-H.2. The amino acid the heavy and light chain CDRs, and the amino acid and nucleotide sequences of the heavy and light chain variable regions, and the heavy and light chains are shown.

| | Antibody A (murine) | |
|---|---|---|
| SEQ ID NO: 3 | HC CDR1 (Combined) | GYSFTTYYIH |
| SEQ ID NO: 4 | HC CDR2 (Combined) | WFFPGSGNIKYNEKFKG |
| SEQ ID NO: 5 | HC CDR3 (Combined) | SYYSYDVLDY |
| SEQ ID NO: 45 | HC CDR1 (Kabat) | TYYIH |
| SEQ ID NO: 46 | HC CDR2 (Kabat) | WFFPGSGNIKYNEKFKG |
| SEQ ID NO: 47 | HC CDR3 (Kabat) | SYYSYDVLDY |
| SEQ ID NO: 48 | HC CDR1 (Chothia) | GYSFTTY |
| SEQ ID NO: 49 | HC CDR2 (Chothia) | FPGSGN |
| SEQ ID NO: 50 | HC CDR3 (Chothia) | SYYSYDVLDY |
| SEQ ID NO: 1 | VH | QVQLQQSGPELVKPGTSVKISCKASGYSFTTYYIHWVKQRPGQGLEWIGWFFPGSGNIKYNEKFKGKATLTADTSSSTAYMQLSSLTSEESAVYFCAGSYYSYDVLDYWGHGTTLTVSS |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 51 | LC CDR1 (Kabat) | KASQNVGINVV |
| SEQ ID NO: 52 | LC CDR2 (Kabat) | SSSHRYS |
| SEQ ID NO: 53 | LC CDR3 (Kabat) | QQFKSYPLT |
| SEQ ID NO: 54 | LC CDR1 (Chothia) | KASQNVGINVV |
| SEQ ID NO: 55 | LC CDR2 (chothia) | SSSHRYS |
| SEQ ID NO: 56 | LC CDR3 (chothia) | QQFKSYPLT |
| SEQ ID NO: 2 | VL | DILMTQSQKFMSTSLGDRVSVSCKASQNVGINVVWHQQKPGQSPKALIYSSSHRYSGVPDRFTGSGSGTDFTLTINNVQSEDLAEYFCQQFKSYPLTFGAGTKLELK |
| | Antibody A humanized (A-H antibody) A-H.1 antibody | |
| SEQ ID NO: 3 | HC CDR1 (Combined) | GYSFTTYYIH |
| SEQ ID NO: 4 | HC CDR2 (Combined) | WFFPGSGNIKYNEKFKG |
| SEQ ID NO: 5 | HC CDR3 (Combined) | SYYSYDVLDY |
| SEQ ID NO: 9 | VH | QVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSS |
| SEQ ID NO: 12 | DNA VH | CAGGTGCAGCTGGTTCAGTCTGGCGCCGAAGTGAAGAAACCTGGCTCCTCCGTGAAGGTGTCCTGCAAGGCTTCCGGCTACTCCTTCACCACCTACTACATCCACTGGGTCCGACAGGCCCCTGGACAAGGATTGGAATGGATGGGCTGGTTCTTCCCCGGCTCCGGCAACATCAAGTACAACGAGAAGTTCAAGGGCCGCGTGACCATCACCGCCGACACCTCTACCTCTACCGCCTACATGGAACTGTCCAGCCTGAGATCTGAGGACACCGCCGTGTACTACTGCGCCGGCTCCTACTACTCTTACGACGTGCTGGATTACTGGGGCCAGGGCACCACAGTGACAGTGTCCTCT |
| SEQ ID NO: 69 | VH-IgM constant delta CDC | METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSK |

| | | |
|---|---|---|
| | | LICQATGFSPRQIQVSWLREGKQVGSGVTT DQVQAEAKESGPTTYKVTSTLTIKESDWLG QSMFTCRVDHRGLTFQQNASSMCVPDQDT AIRVFAIPPSFASIFLTKSTKLTCLVTDLTTY DSVTISWTRQNGEAVKTHTNISESHPNATFS AVGEASICEDDWNSGERFTCTVTHTDLASS LKQTISRPKGVALHRPDVYLLPPAREQLNLR ESATITCLVTGFSPADVFVQWMQRGQPLSP EKYVTSAPMPEPQAPGRYFAHSILTVSEEE WNTGETYTCVVAHEALPNRVTERTVDKST GKPTLYNVSLVMSDTAGTCY |
| SEQ ID NO: 70 | VH-IgA1 | METDTLLLWVLLLWVPGSTGQVQLVQSGA EVKKPGSSVKVSCKASGYSFTTYYIHWVRQ APGQGLEWMGWFFPGSGNIKYNEKFKGRV TITADTSTSTAYMELSSLRSEDTAVYYCAGS YYSYDVLDYWGQGTTVTVSSASPTSPKVFP LSLCSTQPDGNVVIACLVQGFFPQEPLSVTW SESGQGVTARNFPPSQDASGDLYTTSSQLTL PATQCLAGKSVTCHVKHYTNPSQDVTVPCP VPSTPPTPSPSTPPTPSPSCCHPRLSLHRPALE DLLLGSEANLTCTLTGLRDASGVTFTWTPSS GKSAVQGPPERDLCGCYSVSSVLPGCAEPW NHGKTFTCTAAYPESKTPLTATLSKSGNTFR PEVHLLPPPSEELALNELVTLTCLARGFSPK DVLVRWLQGSQELPREKYLTWASRQEPSQ GTTTFAVTSILRVAAEDWKKGDTFSCMVG HEALPLAFTQKTIDRLAGKPTHVNVSVVMA EVDGTCY |
| SEQ ID NO: 71 | VH-IgA2 | METDTLLLWVLLLWVPGSTGQVQLVQSGA EVKKPGSSVKVSCKASGYSFTTYYIHWVRQ APGQGLEWMGWFFPGSGNIKYNEKFKGRV TITADTSTSTAYMELSSLRSEDTAVYYCAGS YYSYDVLDYWGQGTTVTVSSASPTSPKVFP LSLDSTPQDGNVVACLVQGFFPQEPLSVT WSESGQNVTARNFPPSQDASGDLYTTSSQL TLPATQCPDGKSVTCHVKHYTNSSQDVTVP CR VPPPPPCCHPRLSLHRPALEDLLLGSEAN LTCTLTGLRDASGATFTWTPSSGKSAVQGP PERDLCGCYSVSSVLPGCAQPWNHGETFTC TAAHPELKTPLTANITKSGNTFRPEVHLLPP PSEELALNELVTLTCLARGFSPKDVLVRWL QGSQELPREKYLTWASRQEPSQGTTTYAVT SILRVAAEDWKKGETFSCMVGHEALPLAFT QKTIDRMAGKPTHINVSVVMAEADGTCY |
| SEQ ID NO: 3278 | Heavy chain | METDTLLLWVLLLWVPGSTGQVQLVQSGA EVKKPGSSVKVSCKASGYSFTTYYIHWVRQ APGQGLEWMGWFFPGSGNIKYNEKFKGRV TITADTSTSTAYMELSSLRSEDTAVYYCAGS YYSYDVLDYWGQGTTVTVSSASTKGPSVFP LAPSSKSTSGGTAALGCLVKDYFPEPVTVS WNSGALTSGVHTFPAVLQSSGLYSLSSVVT VPSSSLGTQTYICNVNHKPSNTKVDKRVEP KSCDKTHTCPPCPAPELLGGPSVFLFPPKPK DTLMISRTPEVTCVVVDVSHEDPEVKFNWY VDGVEVHNAKTKPREEQYNSTYRVVSVLT VLHQDWLNGKEYKCKVSNKALPAPIEKTIS KAKGQPREPQVYTLPPSREEMTKNQVSLTC LVKGFYPSDIAVEWESNGQPENNYKTTPPV LDSDGSFFLYSKLTVDKSRWQQGNVFSCSV MHEALHNHYTQK SLSLSPGK |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 10 | VL | DIQMTQSPSFLSASVGDRVTITCKASQNVGI NVVWHQQKPGKAPKALIYSSSHRYSGVPSR FSGSGSGTEFTLTISSLQPEDFATYFCQQFKS YPLTFGQGTKLEIK |
| SEQ ID NO: 13 | DNA VL | GACATCCAGATGACCCAGTCTCCATCCTT CCTGTCCGCCTCTGTGGGCGACAGAGTGA CCATCACATGCAAGGCCTCTCAGAACGTG GGCATCAACGTCGTGTGGCACCAGCAGAA GCCTGGCAAGGCTCCTAAGGCTCTGATCT ACTCCTCCAGCCACCGGTACTCTGGCGTG CCCTCTAGATTTTCCGGCTCTGGCTCTGGC ACCGAGTTTACCCTGACAATCTCCAGCCT GCAGCCTGAGGACTTCGCCACCTACTTTT GCCAGCAGTTCAAGAGCTACCCTCTGACC TTTGGCCAGGGCACCAAGCTGGAAATCAA G |

| | | |
|---|---|---|
| SEQ ID NO: 72 | VL and kappa constant region/light chain | METDTLLLWVLLLWVPGSTGDIQMTQSPSF LSASVGDRVTITCKASQNVGINVVWHQQKP GKAPKALIYSSSHRYSGVPSRFSGSGSGTEF TLTISSLQPEDFATYFCQQFKSYPLTFGQGT KLEIKRTVAAPSVFIFPPSDEQLKSGTASVVC LLNNFYPREAKVQWKVDNALQSGNSQESV TEQDSKDSTYSLSSTLTLSKADYEKHKVYA CEVTHQGLSSPVTKSFNRGEC |

A-H.2 antibody

| | | |
|---|---|---|
| SEQ ID NO: 3 | HC CDR1 (Combined) | GYSFTTYYIH |
| SEQ ID NO: 4 | HC CDR2 (Combined) | WFFPGSGNIKYNEKFKG |
| SEQ ID NO: 5 | HC CDR3 (Combined) | SYYSYDVLDY |
| SEQ ID NO: 9 | VH | QVQLVQSGAEVKKPGSSVKVSCKASGYSFT TYYIHWVRQAPGQGLEWMGWFFPGSGNIK YNEKFKGRVTITADTSTSTAYMELSSLRSED TAVYYCAGSYYSYDVLDYWGQGTTVTVSS |
| SEQ ID NO: 12 | DNA VH | CAGGTGCAGCTGGTTCAGTCTGGCGCCGA TGTCCTGCAAGGCTTCCGGCTACTCCTTCA CCACCTACTACATCCACTGGGTCCGACAG GCCCCTGGACAAGGATTGGAATGGATGG GCTGGTTCTTCCCCGGCTCCGGCAACATC AAGTACAACGAGAAGTTCAAGGGCCGCG TGACCATCACCGCCGACACCTCTACCTCT ACCGCCTACATGGAACTGTCCAGCCTGAG ATCTGAGGACACCGCCGTGTACTACTGCG CCGGCTCCTACTACTCTTACGACGTGCTG GATTACTGGGGCCAGGGCACCACAGTGAC AGTGTCCTCT METDTLLLWVLLLWVPGSTGQVQLVQSGA EVKKPGSSVKVSCKASGYSFTTYYIHWVRQ APGQGLEWMGWFFPGSGNIKYNEKFKGRV TITADTSTSTAYMELSSLRSEDTAVYYCAGS YYSYDVLDYWGQGTTVTVSSASTKGPSVFP LAPSSKSTSGGTAALGCLVKDYFPEPVTVS WNSGALTSGVHTFPAVLQSSGLYSLSSVVT VPSSSLGTQTYICNVNHKPSNTKVDKRVEP KSCDKTHTCPPCPAPELLGGPSVFLFPPKPK DTLMISRTPEVTCVVVDVSHEDPEVKFNWY VDGVEVHNAKTKPREEQYNSTYRVVSVLT VLHQDWLNGKEYKCKVSNKALPAPIEKTIS KAKGQPREPQVYTLPPSREEMTKNQVSLTC LVKGFYPSDIAVEWESNGQPENNYKTTPPV LDSDGSFFLYSKLTVDKSRWQQGNVFSCSV MHEALHNHYTQKSLSLSPGK |
| SEQ ID NO: 3278 | Heavy chain | AGTGAAGAAACCTGGCTCCTCCGTGAAGG |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 11 | VL | DIQMTQSPSSLSASVGDRVTITCKASQNVGI NVVWHQQKPGKVPKALIYSSSHRYSGVPSR FSGSGSGTDFTLTISSLQPEDVATYFCQQFKS YPLTFGQGTKLEIK |
| SEQ ID NO: 14 | DNA VL | GACATCCAGATGACCCAGTCTCCATCCTC TCTGTCCGCCTCTGTGGGCGACAGAGTGA CCATCACATGCAAGGCCTCTCAGAACGTG GGCATCAACGTCGTGTGGCACCAGCAGAA ACCTGGCAAGGTGCCCAAGGCTCTGATCT ACTCCTCCAGCCACAGATACTCCGGCGTG CCCTCTAGATTCTCCGGCTCTGGCTCTGGC ACCGACTTTACCCTGACAATCTCCAGCCT GCAGCCTGAGGACGTGGCCACCTACTTTT GCCAGCAGTTCAAGAGCTACCCTCTGACC TTTGGCCAGGGCACCAAGCTGGAAATCAA G |
| SEQ ID NO: 3279 | Light chain | METDTLLLWVLLLWVPGSTGDIQMTQSPSS LSASVGDRVTITCKASQNVGINVVWHQQKP GKVPKALIYSSSHRYSGVPSRFSGSGSGTDF TLTISSLQPEDVATYFCQQFKSYPLTFGQGT KLEIKRTVAAPSVFIFPPSDEQLKSGTASVVC LLNNFYPREAKVQWKVDNALQSGNSQESV TEQDSKDSTYSLSSTLTLSKADYEKHKVYA CEVTHQGLSSPVTKSFNRGEC |

|                | A-H.3 antibody |                                                                                                                                                                                                                                                                                                                                                                            |
|----------------|----------------|----------------------------------------------------------------------------------------------------------------------------------------------------------------------------------------------------------------------------------------------------------------------------------------------------------------------------------------------------------------------------|
| SEQ ID NO: 80  | VH + VL        | QVQLVQSGAEVKKPGSSVKVSCKASGTDF KLTYIHWVRQAPGQGLEWMGRVSPGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVEDRVAWYQQ KPGKAPKALIYSSSHRYKGVPSRFSGSGSGT EFTLTISSLQPEDFATYFCQQFKSYPLTFGQG TKLEIK |
| SEQ ID NO: 81  | VL             | DIQMTQSPSFLSASVGDRVTITCKASQNVED RVAWYQQKPGKAPKALIYSSSHRYKGVPSR FSGSGSGTEFTLTISSLQPEDFATYFCQQFKS YPLTFGQGTKLEIK |
| SEQ ID NO: 82  | VH             | QVQLVQSGAEVKKPGSSVKVSCKASGTDF KLTYIHWVRQAPGQGLEWMGRVSPGSGNT KYNEKFKGRVTITADTSTSTAYMELSSLRSE DTAVYYCAGSYYSYDVLDYWGQGTTVTVS S |
|                | A-H.4          |                                                                                                                                                                                                                                                                                                                                                                            |
| SEQ ID NO: 83  | VH + VL        | QVQLVQSGAEVKKPGSSVKVSCKASGTDF DKIYIHWVRQAPGQGLEWMGRISAGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVEDRVAWYQQ KPGKAPKALIYSSSHRYKGVPSRFSGSGSGT EFTLTISSLQPEDFATYFCQQFKSYPLTFGQG TKLEIK |
| SEQ ID NO: 84  | VL             | DIQMTQSPSFLSASVGDRVTITCKASQNVED RVAWYQQKPGKAPKALIYSSSHRYKGVPSR FSGSGSGTEFTLTISSLQPEDFATYFCQQFKS YPLTFGQGTKLEIK |
| SEQ ID NO: 85  | VH             | QVQLVQSGAEVKKPGSSVKVSCKASGTDF DKIYIHWVRQAPGQGLEWMGRISAGSGNV KYNEKFKGRVTITADTSTSTAYMELSSLRSE DTAVYYCAGSYYSYDVLDYWGQGTTVTVS S |
|                | A-H.5          |                                                                                                                                                                                                                                                                                                                                                                            |
| SEQ ID NO: 86  | VH + VL        | QVQLVQSGAEVKKPGSSVKVSCKASGHDF RDFYIHWVRQAPGQGLEWMGRVYPGSGSY RYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVDDRVAWYQQ KPGKAPKALIYSSSHRYKGVPSRFSGSGSGT EFTLTISSLQPEDFATYFCQQFKSYPLTFGQG TKLEIK |
| SEQ ID NO: 87  | VL             | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 88  | VH             | QVQLVQSGAEVKKPGSSVKVSCKASGHDF RDFYIHWVRQAPGQGLEWMGRVYPGSGSY RYNEKFKGRVTITADTSTSTAYMELSSLRSE DTAVYYCAGSYYSYDVLDYWGQGTTVTVS S |
|                | A-H.6          |                                                                                                                                                                                                                                                                                                                                                                            |
| SEQ ID NO: 89  | VH + VL        | QVQLVQSGAEVKKPGSSVKVSCKASGHDF KLTYIHWVRQAPGQGLEWMGRISAGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVDNRVAWYQQ KPGKAPKALIYSSSHRYKGVPSRFSGSGSGT EFTLTISSLQPEDFATYFCQQFKSYPLTFGQG TKLEIK |
| SEQ ID NO: 90  | VL             | DIQMTQSPSFLSASVGDRVTITCKASQNVDN RVAWYQQKPGKAPKALIYSSSHRYKGVPSR FSGSGSGTEFTLTISSLQPEDFATYFCQQFKS YPLTFGQGTKLEIK |

| | | |
|---|---|---|
| SEQ ID NO: 91 | VH | QVQLVQSGAEVKKPGSSVKVSCKASGHDF<br>KLTYIHWVRQAPGQGLEWMGRISAGSGNV<br>KYNEKFKGRVTITADTSTSTAYMELSSLRSE<br>DTAVYYCAGSYYSYDVLDYWGQGTTVTVS<br>S<br>A-H.7 |
| SEQ ID NO: 92 | VH + VL | QVQLVQSGAEVKKPGSSVKVSCKASGTDF<br>KLTYIHWVRQAPGQGLEWMGRIFPGSGNV<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVENKVAWHQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 93 | VL | DIQMTQSPSFLSASVGDRVTITCKASQNVEN<br>KVAWHQQKPGKAPKALIYSSSHRYKGVPS<br>RFSGSGSGTEFTLTISSLQPEDFATYFCQQFK<br>SYPLTFGQGTKLEIK |
| SEQ ID NO: 94 | VH | QVQLVQSGAEVKKPGSSVKVSCKASGTDF<br>KLTYIHWVRQAPGQGLEWMGRIFPGSGNV<br>KYNEKFKGRVTITADTSTSTAYMELSSLRSE<br>DTAVYYCAGSYYSYDVLDYWGQGTTVTVS<br>S<br>A-H.8 |
| SEQ ID NO: 95 | VH + VL | QVQLVQSGAEVKKPGSSVKVSCKASGTDF<br>DKIYIHWVRQAPGQGLEWMGRIFAGSGNT<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVDDRVAWYQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 96 | VL | DIQMTQSPSFLSASVGDRVTITCKASQNVDD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 97 | VH | QVQLVQSGAEVKKPGSSVKVSCKASGTDF<br>DKIYIHWVRQAPGQGLEWMGRIFAGSGNT<br>KYNEKFKGRVTITADTSTSTAYMELSSLRSE<br>DTAVYYCAGSYYSYDVLDYWGQGTTVTVS<br>S<br>A-H.9 |
| SEQ ID NO: 98 | VH + VL | QVQLVQSGAEVKKPGSSVKVSCKASGHDF<br>DKFYIHWVRQAPGQGLEWMGRVSAGSGN<br>VKYNEKFKGRVTITADTSTSTAYMELSSLRS<br>EDTAVYYCAGSYYSYDVLDYWGQGTTVT<br>VSSGGGGSGGGGSGGGGSGGGGSDIQMTQ<br>SPSFLSASVGDRVTITCKASQNVGNRVAWY<br>QQKPGKAPKALIYSSSHRYSGVPSRFSGSGS<br>GTEFTLTISSLQPEDFATYFCQQFKSYPLTFG<br>QGTKLEIK |
| SEQ ID NO: 99 | VL | DIQMTQSPSFLSASVGDRVTITCKASQNVGN<br>RVAWYQQKPGKAPKALIYSSSHRYSGVPSR<br>FSGSGSGTEFTLTISSLQPEDFATYFCQQFKS<br>YPLTFGQGTKLEIK |
| SEQ ID NO: 100 | VH | QVQLVQSGAEVKKPGSSVKVSCKASGHDF<br>DKFYIHWVRQAPGQGLEWMGRVSAGSGN<br>VKYNEKFKGRVTITADTSTSTAYMELSSLRS<br>EDTAVYYCAGSYYSYDVLDYWGQGTTVT<br>VSS<br>A-H.10 |
| SEQ ID NO: 101 | VH + VL | QVQLVQSGAEVKKPGSSVKVSCKASGHDF<br>DKFYIHWVRQAPGQGLEWMGRIFAGSGNV<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVGDRVAWYQQ<br>KPGKAPKALIYSSSHRYKGVPSRFSGSGSGT<br>EFTLTISSLQPEDFATYFCQQFKSYPLTFGQG<br>TKLEIKS |

-continued

| | | |
|---|---|---|
| SEQ ID NO: 102 | VL | DIQMTQSPSFLSASVGDRVTITCKASQNVGD RVAWYQQKPGKAPKALIYSSSHRYKGVPSR FSGSGSGTEFTLTISSLQPEDFATYFCQQFKS YPLTFGQGTKLEIK |
| SEQ ID NO: 103 | VH | QVQLVQSGAEVKKPGSSVKVSCKASGHDF DKFYIHWVRQAPGQGLEWMGRIFAGSGNV KYNEKFKGRVTITADTSTSTAYMELSSLRSE DTAVYYCAGSYYSYDVLDYWGQGTTVTVS S |
| | | A-H.11 |
| SEQ ID NO: 104 | VH + VL | QVQLVQSGAEVKKPGSSVKVSCKASGTDF KLTYIHWVRQAPGQGLEWMGRVSPGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVGDRVAWYQQ KPGKAPKALIYSSSHRYKGVPSRFSGSGSGT EFTLTISSLQPEDFATYFCQQFKSYPLTFGQG TKLEIK |
| SEQ ID NO: 105 | VL | DIQMTQSPSFLSASVGDRVTITCKASQNVGD RVAWYQQKPGKAPKALIYSSSHRYKGVPSR FSGSGSGTEFTLTISSLQPEDFATYFCQQFKS YPLTFGQGTKLEIK |
| SEQ ID NO: 106 | VH | QVQLVQSGAEVKKPGSSVKVSCKASGTDF KLTYIHWVRQAPGQGLEWMGRVSPGSGNV KYNEKFKGRVTITADTSTSTAYMELSSLRSE DTAVYYCAGSYYSYDVLDYWGQGTTVTVS S |
| | | A-H.12 |
| SEQ ID NO: 107 | VH + VL | QVQLVQSGAEVKKPGSSVKVSCKASGTDF DKIYIHWVRQAPGQGLEWMGRVSAGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVGNRVAWYQQ KPGKAPKALIYSSSHRYKGVPSRFSGSGSGT EFTLTISSLQPEDFATYFCQQFKSYPLTFGQG TKLEIK |
| SEQ ID NO: 108 | VL | DIQMTQSPSFLSASVGDRVTITCKASQNVGN RVAWYQQKPGKAPKALIYSSSHRYKGVPSR FSGSGSGTEFTLTISSLQPEDFATYFCQQFKS YPLTFGQGTKLEIK |
| SEQ ID NO: 109 | VH | QVQLVQSGAEVKKPGSSVKVSCKASGTDF DKIYIHWVRQAPGQGLEWMGRVSAGSGNT KYNEKFKGRVTITADTSTSTAYMELSSLRSE DTAVYYCAGSYYSYDVLDYWGQGTTVTVS S |
| | | A-H.13 |
| SEQ ID NO: 110 | VH + VL | QVQLVQSGAEVKKPGSSVKVSCKASGTDF KLTYIHWVRQAPGQGLEWMGRIFPGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVDNRVAWYQQ KPGKAPKALIYSSSHRYKGVPSRFSGSGSGT EFTLTISSLQPEDFATYFCQQFKSYPLTFGQG TKLEIK |
| SEQ ID NO: 111 | VL | DIQMTQSPSFLSASVGDRVTITCKASQNVDN RVAWYQQKPGKAPKALIYSSSHRYKGVPSR FSGSGSGTEFTLTISSLQPEDFATYFCQQFKS YPLTFGQGTKLEIK |
| SEQ ID NO: 112 | VH | QVQLVQSGAEVKKPGSSVKVSCKASGTDF KLTYIHWVRQAPGQGLEWMGRIFPGSGNV KYNEKFKGRVTITADTSTSTAYMELSSLRSE DTAVYYCAGSYYSYDVLDYWGQGTTVTVS S |
| | | A-H.14 |
| SEQ ID NO: 113 | VH + VL | QVQLVQSGAEVKKPGSSVKVSCKASGTDF DKIYIHWVRQAPGQGLEWMGRISAGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS |

| | | -continued |
|---|---|---|
| | | FLSASVGDRVTITCKASQNVDDRVAWYQQ KPGKAPKALIYSSSHRYKGVPSRFSGSGSGT EFTLTISSLQPEDFATYFCQQFKSYPLTFGQG TKLEIK |
| SEQ ID NO: 114 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 115 | VH | QVQLVQSGAEVKKPGSSVKVSCKASGTDF DKIYIHWVRQAPGQGLEWMGRISAGSGNT KYNEKFKGRVTITADTSTSTAYMELSSLRSE DTAVYYCAGSYYSYDVLDYWGQGTTVTVS S |

A-H.15

| SEQ ID NO: 116 | VH + VL | QVQLVQSGAEVKKPGSSVKVSCKASGTDFR LTYIHWVRQAPGQGLEWMGRVSPGSGNTK YNEKFKGRVTITADTSTSTAYMELSSLRSED TAVYYCAGSYYSYDVLDYWGQGTTVTVSS GGGGSGGGGSGGGGSGGGGSDIQMTQSPSF LSASVGDRVTITCKASQNVDNKVAWHQQK PGKAPKALIYSSSHRYKGVPSRFSGSGSGTE FTLTISSLQPEDFATYFCQQFKSYPLTFGQGT KLEIK |
|---|---|---|
| SEQ ID NO: 117 | VL | DIQMTQSPSFLSASVGDRVTITCKASQNVDN KVAWHQQKPGKAPKALIYSSSHRYKGVPS RFSGSGSGTEFTLTISSLQPEDFATYFCQQFK SYPLTFGQGTKLEIK |
| SEQ ID NO: 118 | VH | QVQLVQSGAEVKKPGSSVKVSCKASGTDFR LTYIHWVRQAPGQGLEWMGRVSPGSGNTK YNEKFKGRVTITADTSTSTAYMELSSLRSED TAVYYCAGSYYSYDVLDYWGQGTTVTVSS |

A-H.16

| SEQ ID NO: 119 | VH + VL | QVQLVQSGAEVKKPGSSVKVSCKASGGTFR LTYIHWVRQAPGQGLEWMGRVYPGSGNTK YNEKFKGRVTITADTSTSTAYMELSSLRSED TAVYYCAGSYYSYDVLDYWGQGTTVTVSS GGGGSGGGGSGGGGSGGGGSDIQMTQSPSF LSASVGDRVTITCKASQNVDDRVAWYQQK PGKAPKALIYSSSHRYKGVPSRFSGSGSGTE FTLTISSLQPEDFATYFCQQFKSYPLTFGQGT KLEIK |
|---|---|---|
| SEQ ID NO: 120 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 121 | VH | QVQLVQSGAEVKKPGSSVKVSCKASGGTFR LTYIHWVRQAPGQGLEWMGRVYPGSGNTK YNEKFKGRVTITADTSTSTAYMELSSLRSED TAVYYCAGSYYSYDVLDYWGQGTTVTVSS |

A-H.17

| SEQ ID NO: 122 | VH + VL | QVQLVQSGAEVKKPGSSVKVSCKASGTDFR LTYIHWVRQAPGQGLEWMGRIFPGSGNTK YNEKFKGRVTITADTSTSTAYMELSSLRSED TAVYYCAGSYYSYDVLDYWGQGTTVTVSS GGGGSGGGGSGGGGSGGGGSDIQMTQSPSF LSASVGDRVTITCKASQNVDDRVAWYQQK PGKAPKALIYSSSHRYKGVPSRFSGSGSGTE FTLTISSLQPEDFATYFCQQFKSYPLTFGQGT KLEIK |
|---|---|---|
| SEQ ID NO: 123 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 124 | VH | QVQLVQSGAEVKKPGSSVKVSCKASGTDFR LTYIHWVRQAPGQGLEWMGRIFPGSGNTK YNEKFKGRVTITADTSTSTAYMELSSLRSED TAVYYCAGSYYSYDVLDYWGQGTTVTVSS |

A-H.18

| SEQ ID NO: 125 | VH + VL | QVQLVQSGAEVKKPGSSVKVSCKASGTDF KLTYIHWVRQAPGQGLEWMGRIFPGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVEDRVAWYQQ KPGKAPKALIYSSSHRYKGVPSRFSGSGSGT |

-continued

| | | |
|---|---|---|
| | | EFTLTISSLQPEDFATYFCQQFKSYPLTFGQG<br>TKLEIK |
| SEQ ID NO: 126 | VL | DIQMTQSPSFLSASVGDRVTITCKASQNVED<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 127 | VH | QVQLVQSGAEVKKPGSSVKVSCKASGTDF<br>KLTYIHWVRQAPGQGLEWMGRIFPGSGNV<br>KYNEKFKGRVTITADTSTSTAYMELSSLRSE<br>DTAVYYCAGSYYSYDVLDYWGQGTTVTVS<br>S<br>A-H.19 |
| SEQ ID NO: 128 | VH + VL | QVQLVQSGAEVKKPGSSVKVSCKASGGTFR<br>LTYIHWVRQAPGQGLEWMGRISAGSGNVK<br>YNEKFKGRVTITADTSTSTAYMELSSLRSED<br>TAVYYCAGSYYSYDVLDYWGQGTTVTVSS<br>GGGGSGGGGSGGGGSGGGGSDIQMTQSPSF<br>LSASVGDRVTITCKASQNVGDRVAWYQQK<br>PGKAPKALIYSSSHRYKGVPSRFSGSGSGTE<br>FTLTISSLQPEDFATYFCQQFKSYPLTFGQGT<br>KLEIK |
| SEQ ID NO: 129 | VL | DIQMTQSPSFLSASVGDRVTITCKASQNVGD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 130 | VH | QVQLVQSGAEVKKPGSSVKVSCKASGGTFR<br>LTYIHWVRQAPGQGLEWMGRISAGSGNVK<br>YNEKFKGRVTITADTSTSTAYMELSSLRSED<br>TAVYYCAGSYYSYDVLDYWGQGTTVTVSS<br>A-H.20 |
| SEQ ID NO: 131 | VH + VL | QVQLVQSGAEVKKPGSSVKVSCKASGGTF<br>DKTYIHWVRQAPGQGLEWMGRISAGSGNT<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVDDRVAWYQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 132 | VL | DIQMTQSPSFLSASVGDRVTITCKASQNVDD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 133 | VH | QVQLVQSGAEVKKPGSSVKVSCKASGGTF<br>DKTYIHWVRQAPGQGLEWMGRISAGSGNT<br>KYNEKFKGRVTITADTSTSTAYMELSSLRSE<br>DTAVYYCAGSYYSYDVLDYWGQGTTVTVS<br>S<br>A-H.21 |
| SEQ ID NO: 134 | VH + VL | QVQLVQSGAEVKKPGSSVKVSCKASGHDF<br>DKFYIHWVRQAPGQGLEWMGRISAGSGNT<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVDDRVAWYQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 135 | VL | DIQMTQSPSFLSASVGDRVTITCKASQNVDD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 136 | VH | QVQLVQSGAEVKKPGSSVKVSCKASGHDF<br>DKFYIHWVRQAPGQGLEWMGRISAGSGNT<br>KYNEKFKGRVTITADTSTSTAYMELSSLRSE<br>DTAVYYCAGSYYSYDVLDYWGQGTTVTVS<br>S<br>A-H.22 |
| SEQ ID NO: 137 | VH + VL | QVQLVQSGAEVKKPGSSVKVSCKASGTDF<br>KLTYIHWVRQAPGQGLEWMGRISAGSGNV<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS |

| | | -continued |
|---|---|---|
| | | FLSASVGDRVTITCKASQNVDNKVAWHQQ KPGKAPKALIYSSSHRYKGVPSRFSGSGSGT EFTLTISSLQPEDFATYFCQQFKSYPLTFGQG TKLEIK |
| SEQ ID NO: 138 | VL | DIQMTQSPSFLSASVGDRVTITCKASQNVDN KVAWHQQKPGKAPKALIYSSSHRYKGVPS RFSGSGSGTEFTLTISSLQPEDFATYFCQQFK SYPLTFGQGTKLEIK |
| SEQ ID NO: 139 | VH | QVQLVQSGAEVKKPGSSVKVSCKASGTDF KLTYIHWVRQAPGQGLEWMGRISAGSGNV KYNEKFKGRVTITADTSTSTAYMELSSLRSE DTAVYYCAGSYYSYDVLDYWGQGTTVTVS S |
| | | A-H.23 |
| SEQ ID NO: 140 | VH + VL | QVQLVQSGAEVKKPGSSVKVSCKASGHDF RLTYIHWVRQAPGQGLEWMGRISAGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVADRVAWYQQ KPGKAPKALIYSSSHRYKGVPSRFSGSGSGT EFTLTISSLQPEDFATYFCQQFKSYPLTFGQG TKLEIK |
| SEQ ID NO: 141 | VL | DIQMTQSPSFLSASVGDRVTITCKASQNVAD RVAWYQQKPGKAPKALIYSSSHRYKGVPSR FSGSGSGTEFTLTISSLQPEDFATYFCQQFKS YPLTFGQGTKLEIK |
| SEQ ID NO: 142 | VH | QVQLVQSGAEVKKPGSSVKVSCKASGHDF RLTYIHWVRQAPGQGLEWMGRISAGSGNV KYNEKFKGRVTITADTSTSTAYMELSSLRSE DTAVYYCAGSYYSYDVLDYWGQGTTVTVS S |
| | | A-H.24 |
| SEQ ID NO: 143 | VH + VL | QVQLVQSGAEVKKPGSSVKVSCKASGHDF HLWYIHWVRQAPGQGLEWMGRVSAGSGN VKYNEKFKGRVTITADTSTSTAYMELSSLRS EDTAVYYCAGSYYSYDVLDYWGQGTTVT VSSGGGGSGGGGSGGGGSGGGGSDIQMTQ SPSFLSASVGDRVTITCKASQNVDNKVAWH QQKPGKAPKALIYSSSHRYKGVPSRFSGSGS GTEFTLTISSLQPEDFATYFCQQFKSYPLTFG QGTKLEIK |
| SEQ ID NO: 144 | VL | DIQMTQSPSFLSASVGDRVTITCKASQNVDN KVAWHQQKPGKAPKALIYSSSHRYKGVPS RFSGSGSGTEFTLTISSLQPEDFATYFCQQFK SYPLTFGQGTKLEIK |
| SEQ ID NO: 145 | VH | QVQLVQSGAEVKKPGSSVKVSCKASGHDF HLWYIHWVRQAPGQGLEWMGRVSAGSGN VKYNEKFKGRVTITADTSTSTAYMELSSLRS EDTAVYYCAGSYYSYDVLDYWGQGTTVT VSS |
| | | A-H.25 |
| SEQ ID NO: 146 | VH + VL | QVQLVQSGAEVKKPGSSVKVSCKASGHDF HLWYIHWVRQAPGQGLEWMGRVFAGSGN TKYNEKFKGRVTITADTSTSTAYMELSSLRS EDTAVYYCAGSYYSYDVLDYWGQGTTVT VSSGGGGSGGGGSGGGGSGGGGSDIQMTQ SPSFLSASVGDRVTITCKASQNVEDKVAWY QQKPGKAPKALIYSSSHRYKGVPSRFSGSGS GTEFTLTISSLQPEDFATYFCQQFKSYPLTFG QGTKLEIK |
| SEQ ID NO: 147 | VL | DIQMTQSPSFLSASVGDRVTITCKASQNVED KVAWYQQKPGKAPKALIYSSSHRYKGVPS RFSGSGSGTEFTLTISSLQPEDFATYFCQQFK SYPLTFGQGTKLEIK |
| SEQ ID NO: 148 | VH | QVQLVQSGAEVKKPGSSVKVSCKASGHDF HLWYIHWVRQAPGQGLEWMGRVFAGSGN TKYNEKFKGRVTITADTSTSTAYMELSSLRS EDTAVYYCAGSYYSYDVLDYWGQGTTVT VSS |
| | | A-H.26 |
| SEQ ID NO: 149 | VH + VL | QVQLVQSGAEVKKPGSSVKVSCKASGTDF KLTYIHWVRQAPGQGLEWMGRIFPGSGNT KYNEKFKGRVTITADTSTSTAYMELSSLRSE DTAVYYCAGSYYSYDVLDYWGQGTTVTVS |

| | | |
|---|---|---|
| | | SGGGGSGGGGSGGGGSGGGGSDIQMTQSPS<br>FLSASVGDRVTITCKASQNVDDRVAWYQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 150 | VL | DIQMTQSPSFLSASVGDRVTITCKASQNVDD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 151 | VH | QVQLVQSGAEVKKPGSSVKVSCKASGTDF<br>KLTYIHWVRQAPGQGLEWMGRIFPGSGNT<br>KYNEKFKGRVTITADTSTSTAYMELSSLRSE<br>DTAVYYCAGSYYSYDVLDYWGQGTTVTVS<br>S<br>A-H.27 |
| SEQ ID NO: 153 | VH + VL | QVQLVQSGAEVKKPGSSVKVSCKASGTDF<br>KLTYIHWVRQAPGQGLEWMGRVSAGSGN<br>VKYNEKFKGRVTITADTSTSTAYMELSSLRS<br>EDTAVYYCAGSYYSYDVLDYWGQGTTVT<br>VSSGGGGSGGGGSGGGGSGGGGSDIQMTQ<br>SPSFLSASVGDRVTITCKASQNVGNRVAWY<br>QQKPGKAPKALIYSSSHRYKGVPSRFSGSGS<br>GTEFTLTISSLQPEDFATYFCQQFKSYPLTFG<br>QGTKLEIK |
| SEQ ID NO: 154 | VL | DIQMTQSPSFLSASVGDRVTITCKASQNVGN<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 155 | VH | QVQLVQSGAEVKKPGSSVKVSCKASGTDF<br>KLTYIHWVRQAPGQGLEWMGRVSAGSGN<br>VKYNEKFKGRVTITADTSTSTAYMELSSLRS<br>EDTAVYYCAGSYYSYDVLDYWGQGTTVT<br>VSS<br>A-H.28 |
| SEQ ID NO: 156 | VH + VL | QVQLVQSGAEVKKPGSSVKVSCKASGTDF<br>KLTYIHWVRQAPGQGLEWMGRISPGSGNT<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVGDRVAWYQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 157 | VL | DIQMTQSPSFLSASVGDRVTITCKASQNVGD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 158 | VH | QVQLVQSGAEVKKPGSSVKVSCKASGTDF<br>KLTYIHWVRQAPGQGLEWMGRISPGSGNT<br>KYNEKFKGRVTITADTSTSTAYMELSSLRSE<br>DTAVYYCAGSYYSYDVLDYWGQGTTVTVS<br>S<br>A-H.29 |
| SEQ ID NO: 159 | VH + VL | QVQLVQSGAEVKKPGSSVKVSCKASGHDF<br>HLWYIHWVRQAPGQGLEWMGRISPGSGNV<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVGDRVAWHQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 160 | VL | DIQMTQSPSFLSASVGDRVTITCKASQNVGD<br>RVAWHQQKPGKAPKALIYSSSHRYKGVPSR<br>FSGSGSGTEFTLTISSLQPEDFATYFCQQFKS<br>YPLTFGQGTKLEIK |
| SEQ ID NO: 161 | VH | QVQLVQSGAEVKKPGSSVKVSCKASGHDF<br>HLWYIHWVRQAPGQGLEWMGRISPGSGNV<br>KYNEKFKGRVTITADTSTSTAYMELSSLRSE<br>DTAVYYCAGSYYSYDVLDYWGQGTTVTVS<br>S<br>A-H.31 |
| SEQ ID NO: 162 | VH + VL | QVQLVQSGAEVKKPGSSVKVSCKASGHDF<br>KLTYIHWVRQAPGQGLEWMGRISAGSGNV<br>KYNEKFKGRVTITADTSTSTAYMELSSLRSE |

-continued

| | | |
|---|---|---|
| | | DTAVYYCAGSYYSYDVLDYWGQGTTVTVS SGGGGSGGGGSGGGGSGGGGSDIQMTQSPS FLSASVGDRVTITCKASQNVDDRVAWYQQ KPGKAPKALIYSSSHRYKGVPSRFSGSGSGT EFTLTISSLQPEDFATYFCQQFKSYPLTFGQG TKLEIK |
| SEQ ID NO: 163 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 164 | VH | QVQLVQSGAEVKKPGSSVKVSCKASGHDF KLTYIHWVRQAPGQGLEWMGRISAGSGNV KYNEKFKGRVTITADTSTSTAYMELSSLRSE DTAVYYCAGSYYSYDVLDYWGQGTTVTVS S |

A-H.31

| SEQ ID NO: 165 | VH + VL | QVQLVQSGAEVKKPGSSVKVSCKASGTDF HLWYIHWVRQAPGQGLEWMGRVFAGSGS YRYNEKFKGRVTITADTSTSTAYMELSSLRS EDTAVYYCAGSYYSYDVLDYWGQGTTVT VSSGGGGSGGGGSGGGGSGGGGSDIQMTQ SPSFLSASVGDRVTITCKASQNVDDRVAWY QQKPGKAPKALIYSSSHRYKGVPSRFSGSGS GTEFTLTISSLQPEDFATYFCQQFKSYPLTFG QGTKLEIK |
|---|---|---|
| SEQ ID NO: 166 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 167 | VH | QVQLVQSGAEVKKPGSSVKVSCKASGTDF HLWYIHWVRQAPGQGLEWMGRVFAGSGS YRYNEKFKGRVTITADTSTSTAYMELSSLRS EDTAVYYCAGSYYSYDVLDYWGQGTTVT VSS |

A-H.32

| SEQ ID NO: 168 | VH + VL | QVQLVQSGAEVKKPGSSVKVSCKASGTDF DKIYIHWVRQAPGQGLEWMGRISAGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVADRVAWYQQ KPGKAPKALIYSSSHRYKGVPSRFSGSGSGT EFTLTISSLQPEDFATYFCQQFKSYPLTFGQG TKLEIK |
|---|---|---|
| SEQ ID NO: 169 | VL | DIQMTQSPSFLSASVGDRVTITCKASQNVAD RVAWYQQKPGKAPKALIYSSSHRYKGVPSR FSGSGSGTEFTLTISSLQPEDFATYFCQQFKS YPLTFGQGTKLEIK |
| SEQ ID NO: 170 | VH | QVQLVQSGAEVKKPGSSVKVSCKASGTDF DKIYIHWVRQAPGQGLEWMGRISAGSGNT KYNEKFKGRVTITADTSTSTAYMELSSLRSE DTAVYYCAGSYYSYDVLDYWGQGTTVTVS S |

A-H.33

| SEQ ID NO: 171 | VH + VL | QVQLVQSGAEVKKPGSSVKVSCKASGTDF KLTYIHWVRQAPGQGLEWMGRISAGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVEDRVAWYQQ KPGKAPKALIYSSSHRYKGVPSRFSGSGSGT EFTLTISSLQPEDFATYFCQQFKSYPLTFGQG TKLEIK |
|---|---|---|
| SEQ ID NO: 172 | VI | DIQMTQSPSFLSASVGDRVTITCKASQNVED RVAWYQQKPGKAPKALIYSSSHRYKGVPSR FSGSGSGTEFTLTISSLQPEDFATYFCQQFKS YPLTFGQGTKLEIK |
| SEQ ID NO: 173 | VH | QVQLVQSGAEVKKPGSSVKVSCKASGTDF KLTYIHWVRQAPGQGLEWMGRISAGSGNT KYNEKFKGRVTITADTSTSTAYMELSSLRSE DTAVYYCAGSYYSYDVLDYWGQGTTVTVS S |

A-H.34

| SEQ ID NO: 174 | VH + VL | QVQLVQSGAEVKKPGSSVKVSCKASGTDFR LTYIHWVRQAPGQGLEWMGRISPGSGNTK |
|---|---|---|

|   |   |   |
|---|---|---|
|   |   | YNEKFKGRVTITADTSTSTAYMELSSLRSED<br>TAVYYCAGSYYSYDVLDYWGQGTTVTVSS<br>GGGGSGGGGSGGGGSGGGGSDIQMTQSPSF<br>LSASVGDRVTITCKASQNVGNRVAWYQQK<br>PGKAPKALIYSSSHRYKGVPSRFSGSGSGTE<br>FTLTISSLQPEDFATYFCQQFKSYPLTFGQGT<br>KLEIK |
| SEQ ID NO: 175 | VL | DIQMTQSPSFLSASVGDRVTITCKASQNVGN<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 176 | VH | QVQLVQSGAEVKKPGSSVKVSCKASGTDFR<br>LTYIHWVRQAPGQGLEWMGRISPGSGNTK<br>YNEKFKGRVTITADTSTSTAYMELSSLRSED<br>TAVYYCAGSYYSYDVLDYWGQGTTVTVSS<br>A-H.35 |
| SEQ ID NO: 177 | VH + VL | QVQLVQSGAEVKKPGSSVKVSCKASGHDF<br>DKTYIHWVRQAPGQGLEWMGRVSAGSGN<br>VKYNEKFKGRVTITADTSTSTAYMELSSLRS<br>EDTAVYYCAGSYYSYDVLDYWGQGTTVT<br>VSSGGGGSGGGGSGGGGSGGGGSDIQMTQ<br>SPSFLSASVGDRVTITCKASQNVEDRVAWY<br>QQKPGKAPKALIYSSSHRYKGVPSRFSGSGS<br>GTEFTLTISSLQPEDFATYFCQQFKSYPLTFG<br>QGTKLEIK |
| SEQ ID NO: 178 | VL | DIQMTQSPSFLSASVGDRVTITCKASQNVED<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 179 | VH | QVQLVQSGAEVKKPGSSVKVSCKASGHDF<br>DKTYIHWVRQAPGQGLEWMGRVSAGSGN<br>VKYNEKFKGRVTITADTSTSTAYMELSSLRS<br>EDTAVYYCAGSYYSYDVLDYWGQGTTVT<br>VSS<br>A-H.36 |
| SEQ ID NO: 180 | VH + VL | QVQLVQSGAEVKKPGSSVKVSCKASGHDF<br>KLTYIHWVRQAPGQGLEWMGRVSPGSGNT<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVEDRVAWHQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 181 | VL | DIQMTQSPSFLSASVGDRVTITCKASQNVED<br>RVAWHQQKPGKAPKALIYSSSHRYKGVPSR<br>FSGSGSGTEFTLTISSLQPEDFATYFCQQFKS<br>YPLTFGQGTKLEIK |
| SEQ ID NO: 182 | VH | QVQLVQSGAEVKKPGSSVKVSCKASGHDF<br>KLTYIHWVRQAPGQGLEWMGRVSPGSGNT<br>KYNEKFKGRVTITADTSTSTAYMELSSLRSE<br>DTAVYYCAGSYYSYDVLDYWGQGTTVTVS<br>S<br>A-H.37 |
| SEQ ID NO: 183 | VH + VL | QVQLVQSGAEVKKPGSSVKVSCKASGHDF<br>DKTYIHWVRQAPGQGLEWMGRIYPGSGNV<br>KYNEKFKGRVTITADTSTSTAYMELSSLRSE<br>DTAVYYCAGSYYSYDVLDYWGQGTTVTVS<br>SGGGGSGGGGSGGGGSGGGGSDIQMTQSPS<br>FLSASVGDRVTITCKASQNVADRVAWYQQ<br>KPGKAPKALIYSSSHRYKGVPSRFSGSGSGT<br>EFTLTISSLQPEDFATYFCQQFKSYPLTFGQG<br>TKLEIK |
| SEQ ID NO: 184 | VL | DIQMTQSPSFLSASVGDRVTITCKASQNVAD<br>RVAWYQQKPGKAPKALIYSSSHRYKGVPSR<br>FSGSGSGTEFTLTISSLQPEDFATYFCQQFKS<br>YPLTFGQGTKLEIK |
| SEQ ID NO: 185 | VH | QVQLVQSGAEVKKPGSSVKVSCKASGHDF<br>DKTYIHWVRQAPGQGLEWMGRIYPGSGNV<br>KYNEKFKGRVTITADTSTSTAYMELSSLRSE<br>DTAVYYCAGSYYSYDVLDYWGQGTTVTVS<br>S<br>A-H.38 |
| SEQ ID NO: 186 | VH + VL | QVQLVQSGAEVKKPGSSVKVSCKASGTDF<br>DKTYIHWVRQAPGQGLEWMGRISAGSGNV |

-continued

|  |  |  |
|---|---|---|
|  |  | KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVDDRVAWYQQ KPGKAPKALIYSSSHRYKGVPSRFSGSGSGT EFTLTISSLQPEDFATYFCQQFKSYPLTFGQG TKLEIK |
| SEQ ID NO: 187 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 188 | VH | QVQLVQSGAEVKKPGSSVKVSCKASGTDF DKTYIHWVRQAPGQGLEWMGRISAGSGNV KYNEKFKGRVTITADTSTSTAYMELSSLRSE DTAVYYCAGSYYSYDVLDYWGQGTTVTVS S |

A-H.39

| SEQ ID NO: 189 | VH + VL | QVQLVQSGAEVKKPGSSVKVSCKASGTDF DKIYIHWVRQAPGQGLEWMGRISAGSGNIK YNEKFKGRVTITADTSTSTAYMELSSLRSED TAVYYCAGSYYSYDVLDYWGQGTTVTVSS GGGGSGGGGSGGGGSGGGGSDIQMTQSPSF LSASVGDRVTITCKASQNVDDRVAWYQQK PGKAPKALIYSSSHRYKGVPSRFSGSGSGTE FTLTISSLQPEDFATYFCQQFKSYPLTFGQGT KLEIK |
|---|---|---|
| SEQ ID NO: 190 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 191 | VH | QVQLVQSGAEVKKPGSSVKVSCKASGTDF DKIYIHWVRQAPGQGLEWMGRISAGSGNIK YNEKFKGRVTITADTSTSTAYMELSSLRSED TAVYYCAGSYYSYDVLDYWGQGTTVTVSS |

A-H.40

| SEQ ID NO: 192 | VH + VL | QVQLVQSGAEVKKPGSSVKVSCKASGTDF DKIYIHWVRQAPGQGLEWMGRISAGSGNV KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVGDRVAWYQQ KPGKAPKALIYSSSHRYKGVPSRFSGSGSGT EFTLTISSLQPEDFATYFCQQFKSYPLTFGQG TKLEIK |
|---|---|---|
| SEQ ID NO: 193 | VL | DIQMTQSPSFLSASVGDRVTITCKASQNVGD RVAWYQQKPGKAPKALIYSSSHRYKGVPSR FSGSGSGTEFTLTISSLQPEDFATYFCQQFKS YPLTFGQGTKLEIK |
| SEQ ID NO: 194 | VH | QVQLVQSGAEVKKPGSSVKVSCKASGTDF DKIYIHWVRQAPGQGLEWMGRISAGSGNV KYNEKFKGRVTITADTSTSTAYMELSSLRSE DTAVYYCAGSYYSYDVLDYWGQGTTVTVS S |

A-H.41

| SEQ ID NO: 195 | VH + VL | QVQLVQSGAEVKKPGSSVKVSCKASGGTF KLTYIHWVRQAPGQGLEWMGRVSAGSGN VKYNEKFKGRVTITADTSTSTAYMELSSLRS EDTAVYYCAGSYYSYDVLDYWGQGTTVT VSSGGGGSGGGGSGGGGSGGGGSDIQMTQ SPSFLSASVGDRVTITCKASQNVDDRVAWY QQKPGKAPKALIYSSSHRYKGVPSRFSGSGS GTEFTLTISSLQPEDFATYFCQQFKSYPLTFG QGTKLEIK |
|---|---|---|
| SEQ ID NO: 196 | VL | DIQMTQSPSFLSASVGDRVTITCKASQNVDD RVAWYQQKPGKAPKALIYSSSHRYKGVPSR FSGSGSGTEFTLTISSLQPEDFATYFCQQFKS YPLTFGQGTKLEIK |
| SEQ ID NO: 197 | VH | QVQLVQSGAEVKKPGSSVKVSCKASGGTF KLTYIHWVRQAPGQGLEWMGRVSAGSGN VKYNEKFKGRVTITADTSTSTAYMELSSLRS EDTAVYYCAGSYYSYDVLDYWGQGTTVT VSS |

A-H.42

| SEQ ID NO: 198 | VH + VL | QVQLVQSGAEVKKPGSSVKVSCKASGTDF KLTYIHWVRQAPGQGLEWMGRISPGSGNV |
|---|---|---|

| | | |
|---|---|---|
| | | KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVDNRVAWHQQ KPGKAPKALIYSSSHRYKGVPSRFSGSGSGT EFTLTISSLQPEDFATYFCQQFKSYPLTFGQG TKLEIK |
| SEQ ID NO: 199 | VL | DIQMTQSPSFLSASVGDRVTITCKASQNVDN RVAWHQQKPGKAPKALIYSSSHRYKGVPSR FSGSGSGTEFTLTISSLQPEDFATYFCQQFKS YPLTFGQGTKLEIK |
| SEQ ID NO: 200 | VH | QVQLVQSGAEVKKPGSSVKVSCKASGTDF KLTYIHWVRQAPGQGLEWMGRISPGSGNV KYNEKFKGRVTITADTSTSTAYMELSSLRSE DTAVYYCAGSYYSYDVLDYWGQGTTVTVS S |

A-H.43

| | | |
|---|---|---|
| SEQ ID NO: 201 | VH + VL | QVQLVQSGAEVKKPGSSVKVSCKASGHDF DKFYIHWVRQAPGQGLEWMGRVSAGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVDNRVAWYQQ KPGKAPKALIYSSSHRYKGVPSRFSGSGSGT EFTLTISSLQPEDFATYFCQQFKSYPLTFGQG TKLEIK |
| SEQ ID NO: 202 | VL | DIQMTQSPSFLSASVGDRVTITCKASQNVDN RVAWYQQKPGKAPKALIYSSSHRYKGVPSR FSGSGSGTEFTLTISSLQPEDFATYFCQQFKS YPLTFGQGTKLEIK |
| SEQ ID NO: 203 | VH | QVQLVQSGAEVKKPGSSVKVSCKASGHDF DKFYIHWVRQAPGQGLEWMGRVSAGSGNT KYNEKFKGRVTITADTSTSTAYMELSSLRSE DTAVYYCAGSYYSYDVLDYWGQGTTVTVS S |

A-H.44

| | | |
|---|---|---|
| SEQ ID NO: 204 | VH + VL | QVQLVQSGAEVKKPGSSVKVSCKASGTDF DKFYIHWVRQAPGQGLEWMGRVSAGSGN VKYNEKFKGRVTITADTSTSTAYMELSSLRS EDTAVYYCAGSYYSYDVLDYWGQGTTVT VSSGGGGSGGGGSGGGGSGGGGSDIQMTQ SPSFLSASVGDRVTITCKASQNVGDRVVWY QQKPGKAPKALIYSSSHRYKGVPSRFSGSGS GTEFTLTISSLQPEDFATYFCQQFKSYPLTFG QGTKLEIK |
| SEQ ID NO: 205 | VH | QVQLVQSGAEVKKPGSSVKVSCKASGTDF DKFYIHWVRQAPGQGLEWMGRVSAGSGN VKYNEKFKGRVTITADTSTSTAYMELSSLRS EDTAVYYCAGSYYSYDVLDYWGQGTTVT VSS |

A-H.45

| | | |
|---|---|---|
| SEQ ID NO: 206 | VH + VL | QVQLVQSGAEVKKPGSSVKVSCKASGYSFT TYYIHWVRQAPGQGLEWMGWFSAGSGNT KYNEKFKGRVTITADTSTSTAYMELSSLRSE DTAVYYCAVSYYSYDVLDYWGQGTTVTVS SGGGGSGGGGSGGGGSGGGGSDIQMTQSPS FLSASVGDRVTITCKASQNVGINVVWHQQK PGKAPKALIYSSSHRYSGVPSRFSGSGSGTE FTLTISSLQPEDFATYFCQQFKSYPLTFGQGT KLEIK |
| SEQ ID NO: 207 | VH | QVQLVQSGAEVKKPGSSVKVSCKASGYSFT TYYIHWVRQAPGQGLEWMGWFSAGSGNT KYNEKFKGRVTITADTSTSTAYMELSSLRSE DTAVYYCAVSYYSYDVLDYWGQGTTVTVS S |

A-H.46

| | | |
|---|---|---|
| SEQ ID NO: 208 | VH + VL | QVQLVQSGAEVKKPGSSVKVSCKASGYSFT TYYIHWVRQAPGQGLEWMGWFSAGSGNT KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVGINVVWHQQK PGKAPKALIYSSSHRYSGVPSRFSGSGSGTE FTLTISSLQPEDFATYFCQQFKSYPLTFGQGT KLEIK |

| SEQ ID NO: 209 | VH | QVQLVQSGAEVKKPGSSVKVSCKASGYSFT
TYYIHWVRQAPGQGLEWMGWFSAGSGNT
KYNEKFKGRVTITADTSTSTAYMELSSLRSE
DTAVYYCAGSYYSYDVLDYWGQGTTVTVS
S
A-H.47 |
|---|---|---|
| SEQ ID NO: 210 | VH + VL | QVOLVOSGAEVKKPGSSVKVSCKASGYSFT
TYYIHWVROAPGOGLEWMGWFFPGSGNTK
YNEKFKGRVTITADTSTSTAYMELSSLRSED
TAVYYCAGSYYSYDVLDYWGQGTTVTVSS
GGGGSGGGGSGGGGSGGGGSDIQMTOSPSF
LSASVGDRVTITCKASQNVGINVVWHQQKP
GKAPKALIYSSSHRYSGVPSRFSGSGSGTEF
TLTISSLOPEDFATYFCQQFKSYPLTFGQGT
KLEIK |
| SEQ ID NO: 211 | VH | QVQLVQSGAEVKKPGSSVKVSCKASGYSFT
TYYIHWVRQAPGQGLEWMGWFFPGSGNTK
YNEKFKGRVTITADTSTSTAYMELSSLRSED
TAVYYCAGSYYSYDVLDYWGQGTTVTVSS
A-H.48 |
| SEQ ID NO: 212 | VH + VL | QVQLVQSGAEVKKPGSSVKVSCKASGYSFT
TYYIHWVRQAPGQGLEWMGWFSPGSGNTK
YNEKFKGRVTITADTSTSTAYMELSSLRSED
TAVYYCAVSYYSYDVLDYWGOGTTVTVSS
GGGGSGGGGSGGGGSGGGGSDIQMTQSPSF
LSASVGDRVTITCKASQNVGINVVWHQOKP
GKAPKALIYSSSHRYSGVPSRESGSGSGTEF
TLTISSLOPEDFATYFCQQFKSYPLTFGQGT
KLEIK |
| SEQ ID NO: 213 | VH | QVQLVQSGAEVKKPGSSVKVSCKASGYSFT
TYYIHWVRQAPGQGLEWMGWFSPGSGNTK
YNEKFKGRVTITADTSTSTAYMELSSLRSED
TAVYYCAVSYYSYDVLDYWGQGTTVTVSS
A-H.49 |
| SEQ ID NO: 214 | VH + VL | QVOLVOSGAEVKKPGSSVKVSCKASGYSFT
TYYIHWVRQAPGOGLEWMGWFSPGSGNTK
YNEKFKGRVTITADTSTSTAYMELSSLRSED
TAVYYCAGSYYSYDVLDYWGQGTTVTVSS
GGGGSGGGGSGGGGSGGGGSDIQMTQSPSF
LSASVGDRVTITCKASONVGINVVWHOQKP
GKAPKALIYSSSHRYSGVPSRFSGSGSGTEF
TLTISSLOPEDFATYFCOQFKSYPLTFGQGT
KLEIK |
| SEQ ID NO: 215 | VH | QVQLVQSGAEVKKPGSSVKVSCKASGYSFT
TYYIHWVRQAPGQGLEWMGWFSPGSGNTK
YNEKFKGRVTITADTSTSTAYMELSSLRSED
TAVYYCAGSYYSYDVLDYWGQGTTVTVSS
A-H.50 |
| SEQ ID NO: 216 | VH + VL | QVOLVOSGAEVKKPGSSVKVSCKASGYSFT
TYYIHWVROAPGOGLEWMGRIFPGSGNIKY
NEKFKGRVTITADTSTSTAYMELSSLRSEDT
AVYYCAGSYYSYDVLDYWGQGTTVTVSSG
GGGSGGGGSGGGGSGGGGSDIQMTQSPSFL
SASVGDRVTITCKASQNVGINVVWHQQKP
GKAPKALIYSSSHRYSGVPSRFSGSGSGTEF
TLTISSLOPEDFATYFCQQFKSYPLTFGQGT
KLEIK |
| SEQ ID NO: 217 | VH | QVQLVQSGAEVKKPGSSVKVSCKASGYSFT
TYYIHWVRQAPGQGLEWMGRIFPGSGNIKY
NEKFKGRVTITADTSTSTAYMELSSLRSEDT
AVYYCAGSYYSYDVLDYWGQGTTVTVSS
A-H.51 |
| SEQ ID NO: 218 | VH + VL | QVOLVOSGAEVKKPGSSVKVSCKASGYSFT
TYYIHWVRQAPGQGLEWMGWFFPGSGNIK
YNEKFKGRVTITADTSTSTAYMELSSLRSED
TAVYYCAGSIYSAGVLDYWGQGTTVTVSS
GGGGSGGGGSGGGGSGGGGSDIQMTQSPSF
LSASVGDRVTITCKASONVGINVVWHQQKP
GKAPKALIYSSSHRYSGVPSRFSGSGSGTEF
TLTISSLOPEDFATYFCQQFKSYPLTFGQGT
KLEIK |

-continued

| | | |
|---|---|---|
| SEQ ID NO: 219 | VH | QVQLVQSGAEVKKPGSSVKVSCKASGYSFT TYYIHWVRQAPGQGLEWMGWFFPGSGNIK YNEKFKGRVTITADTSTSTAYMELSSLRSED TAVYYCAGSIYSAGVLDYWGQGTTVTVSS A-H.52 |
| SEQ ID NO: 220 | VH + VL | QVQLVQSGAEVKKPGSSVKVSCKASGYSFT LGYIHWVRQAPGQGLEWMGWFFPGSGNIK YNEKFKGRVTITADTSTSTAYMELSSLRSED TAVYYCAGSYYSYDVLDYWGQGTTVTVSS GGGGSGGGGSGGGGSGGGGSDIQMTQSPSF LSASVGDRVTITCKASQNVGINVVWHQQKP GKAPKALIYSSSHRYSGVPSRFSGSGSGTEF TLTISSLQPEDFATYFCQQFKSYPLTFGQGT KLEIK |
| SEQ ID NO: 221 | VH | QVQLVQSGAEVKKPGSSVKVSCKASGYSFT LGYIHWVRQAPGQGLEWMGWFFPGSGNIK YNEKFKGRVTITADTSTSTAYMELSSLRSED TAVYYCAGSYYSYDVLDYWGQGTTVTVSS A-H.53 |
| SEQ ID NO: 222 | VH + VL | QVQLVQSGAEVKKPGSSVKVSCKASGYSFR LTYIHWVRQAPGOGLEWMGWFFPGSGNIK YNEKFKGRVTITADTSTSTAYMELSSLRSED TAVYYCAGSYYSYDVLDYWGQGTTVTVSS GGGGSGGGGSGGGGSGGGGSDIQMTQSPSF LSASVGDRVTITCKASQNVGINVVWHQQKP GKAPKALIYSSSHRYSGVPSRFSGSGSGTEF TLTISSLOPEDFATYFCQQFKSYPLTFGQGT KLEIK |
| SEQ ID NO: 223 | VH | QVQLVQSGAEVKKPGSSVKVSCKASGYSFR LTYIHWVRQAPGQGLEWMGWFFPGSGNIK YNEKFKGRVTITADTSTSTAYMELSSLRSED TAVYYCAGSYYSYDVLDYWGQGTTVTVSS A-H.54 |
| SEQ ID NO: 224 | VH + VL | QVQLVQSGAEVKKPGSSVKVSCKASGYSFH NWYIHWVRQAPGQGLEWMGWFFPGSGNI KYNEKFKGRVTITADTSTSTAYMELSSLRSE DTAVYYCAGSYYSYDVLDYWGQGTTVTVS SGGGGSGGGGSGGGGSGGGGSDIQMTQSPS FLSASVGDRVTITCKASQNVGINVVWHQQK PGKAPKALIYSSSHRYSGVPSRFSGSGSGTE FTLTISSLQPEDFATYFCQQFKSYPLTFGQGT KLEIK |
| SEQ ID NO: 225 | VH | QVQLVQSGAEVKKPGSSVKVSCKASGYSFH NWYIHWVRQAPGQGLEWMGWFFPGSGNI KYNEKFKGRVTITADTSTSTAYMELSSLRSE DTAVYYCAGSYYSYDVLDYWGQGTTVTVS S |

In some embodiments, the anti-TCRβV antibody molecule, e.g., anti-TCRβ V6 (e.g., anti-TCRβ V6-5*01) antibody molecule comprises a VH and/or a VL of an antibody described in Table 1, or a sequence with at least 80%, 85%, 90%, 95%, 96%, 97%, 98%, 99% or more identity thereto.

In some embodiments, the anti-TCRβV antibody molecule, e.g., anti-TCRβ V6 (e.g., anti-TCRβ V6-5*01) antibody molecule comprises a VH and a VL of an antibody described in Table 1, or a sequence with at least 80%, 85%, 90%, 95%, 96%, 97%, 98%, 99% or more identity thereto.

In some embodiments, an anti-TCRVb antibody disclosed herein has an antigen binding domain having a VL having a consensus sequence of SEQ ID NO: 230, wherein position 30 is G, E, A or D; position 31 is N or D; position 32 is R or K; position 36 is Y or H; and/or position 56 is K or S.

In some embodiments, an anti-TCRVb antibody disclosed herein has an antigen binding domain having a VH having a consensus sequence of SEQ ID NO: 231, wherein: position 27 is H or T or G or Y; position 28 is D or T or S; position 30 is H or R or D or K or T; position 31 is L or D or K or T or N; position 32 is W or F or T or I or Y or G; position 49 is R or W; position 50 is V or I or F; position 51 is F or S or Y; position 52 is A or P; position 56 is N or S; position 57 is T or V or Y or I; position 58 is K or R; position 97 is G or V; position 99 is Y or I; position 102 is Y or A; and/or position 103 is D or G.

Anti-TCRβ V12 Antibodies

Accordingly, in one aspect, the disclosure provides an anti-TCRβV antibody molecule that binds to human TCRβ V12, e.g., a TCRβ V12 subfamily comprising: TCRβ V12-4*01, TCRβ V 12-3*01 or TCRβ V 12-5*01. In some embodiments the TCRβ V12 subfamily comprises TCRβ V12-4*01. In some embodiments the TCRβ V12 subfamily comprises TCRβ V12-3*01.

In some embodiments, the anti-TCRβV antibody molecule, e.g., anti-TCRβ V12 antibody molecule, is a non-murine antibody molecule, e.g., a human or humanized antibody molecule. In some embodiments, the anti-TCRβV antibody molecule, e.g., anti-TCRβ V12 antibody molecule is a human antibody molecule. In some embodiments, the anti-TCRβV antibody molecule, e.g., anti-TCRβ V12 antibody molecule is a humanized antibody molecule.

In some embodiments, the anti-TCRβV antibody molecule, e.g., anti-TCRβ V12 antibody molecule, is isolated or recombinant.

In some embodiments, the anti-TCRβV antibody molecule, e.g., anti-TCRβ V12 antibody molecule, comprises at least one antigen-binding region, e.g., a variable region or an antigen-binding fragment thereof, from an antibody described herein, e.g., an antibody described in Table 2, or encoded by a nucleotide sequence in Table 2, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one, two, three or four variable regions from an antibody described herein, e.g., an antibody as described in Table 2, or encoded by a nucleotide sequence in Table 2, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one or two heavy chain variable regions from an antibody described herein, e.g., an antibody as described in Table 2, or encoded by a nucleotide sequence in Table 2, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one or two light chain variable regions from an antibody described herein, e.g., an antibody as described in Table 2, or encoded by a nucleotide sequence in Table 2, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises a heavy chain constant region for an IgG4, e.g., a human IgG4. In still another embodiment, the anti-TCRβV antibody molecule, e.g., anti-TCRβ V12 antibody molecule, includes a heavy chain constant region for an IgG1, e.g., a human IgG1. In one embodiment, the heavy chain constant region comprises an amino sequence set forth in Table 3, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V12 antibody molecule, includes a kappa light chain constant region, e.g., a human kappa light chain constant region. In one embodiment, the light chain constant region comprises an amino sequence set forth in Table 3, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V12 antibody molecule, includes at least one, two, or three complementarity determining regions (CDRs) from a heavy chain variable region of an antibody described herein, e.g., an antibody as described in Table 2, or encoded by the nucleotide sequence in Table 2, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, includes at least one, two, or three CDRs (or collectively all of the CDRs) from a heavy chain variable region comprising an amino acid sequence shown in Table 2, or encoded by a nucleotide sequence shown in Table 2. In one embodiment, one or more of the CDRs (or collectively all of the CDRs) have one, two, three, four, five, six or more changes, e.g., amino acid substitutions or deletions, relative to the amino acid sequence shown in Table 2, or encoded by a nucleotide sequence shown in Table 2.

In some embodiments, the anti-TCRβV antibody molecule, e.g., anti-TCRβ V12 antibody molecule, includes at least one, two, or three complementarity determining regions (CDRs) from a light chain variable region of an antibody described herein, e.g., an antibody as described in Table 2, or encoded by the nucleotide sequence in Table 2, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, includes at least one, two, or three CDRs (or collectively all of the CDRs) from a light chain variable region comprising an amino acid sequence shown in Table 2, or encoded by a nucleotide sequence shown in Table 2. In one embodiment, one or more of the CDRs (or collectively all of the CDRs) have one, two, three, four, five, six or more changes, e.g., amino acid substitutions or deletions, relative to the amino acid sequence shown in Table 2, or encoded by a nucleotide sequence shown in Table 2.

In some embodiments, the anti-TCRβV antibody molecule, e.g., anti-TCRβ V12 antibody molecule, includes at least one, two, three, four, five or six CDRs (or collectively all of the CDRs) from a heavy and light chain variable region comprising an amino acid sequence shown in Table 2, or encoded by a nucleotide sequence shown in Table 2. In one embodiment, one or more of the CDRs (or collectively all of the CDRs) have one, two, three, four, five, six or more changes, e.g., amino acid substitutions or deletions, relative to the amino acid sequence shown in Table 2, or encoded by a nucleotide sequence shown in Table 2.

In some embodiments, the anti-TCRβV antibody molecule, e.g., anti-TCRβ V12 antibody molecule, molecule includes all six CDRs from an antibody described herein, e.g., an antibody as described in Table 2, or encoded by the nucleotide sequence in Table 2, or closely related CDRs, e.g., CDRs which are identical or which have at least one amino acid alteration, but not more than two, three or four alterations (e.g., substitutions, deletions, or insertions, e.g., conservative substitutions). In some embodiments, the anti-TCRβV antibody molecule, e.g., anti-TCRβ V12 antibody molecule, may include any CDR described herein.

In some embodiments, the anti-TCRβV antibody molecule, e.g., anti-TCRβ V12 antibody molecule includes at least one, two, or three CDRs according to Kabat et al. (e.g., at least one, two, or three CDRs according to the Kabat definition as set out in Table 2) from a heavy chain variable region of an antibody described herein, e.g., an antibody chosen as described in Table 2, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 2.

In some embodiments, the anti-TCRβV antibody molecule, e.g., anti-TCRβ V12 antibody molecule includes at least one, two, or three CDRs according to Kabat et al. (e.g., at least one, two, or three CDRs according to the Kabat definition as set out in Table 2) from a light chain variable region of an antibody described herein, e.g., an antibody as described in Table 2, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 2.

In some embodiments, the anti-TCRβV antibody molecule, e.g., anti-TCRβ V12 antibody molecule includes at least one, two, three, four, five, or six CDRs according to Kabat et al. (e.g., at least one, two, three, four, five, or six CDRs according to the Kabat definition as set out in Table 2) from the heavy and light chain variable regions of an antibody described herein, e.g., an antibody as described in Table 2, or encoded by the nucleotide sequence in Table 2; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Kabat et al. shown in Table 2.

In some embodiments, the anti-TCRβV antibody molecule, e.g., anti-TCRβ V12 antibody molecule includes all six CDRs according to Kabat et al. (e.g., all six CDRs according to the Kabat definition as set out in Table 2) from the heavy and light chain variable regions of an antibody described herein, e.g., an antibody as described in Table 2, or encoded by the nucleotide sequence in Table 2; or encoded by the nucleotide sequence in Table 2; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Kabat et al. shown in Table 2. In some embodiments, the anti-TCRβV antibody molecule, e.g., anti-TCRβ V12 antibody molecule may include any CDR described herein.

In some embodiments, the anti-TCRβV antibody molecule, e.g., anti-TCRβ V12 antibody molecule includes at least one, two, or three hypervariable loops that have the same canonical structures as the corresponding hypervariable loop of an antibody described herein, e.g., an antibody described in Table 2, e.g., the same canonical structures as at least loop 1 and/or loop 2 of the heavy and/or light chain variable domains of an antibody described herein. See, e.g., Chothia et al., (1992) J. Mol. Biol. 227:799-817; Tomlinson et al., (1992) J. Mol. Biol. 227:776-798 for descriptions of hypervariable loop canonical structures. These structures can be determined by inspection of the tables described in these references.

In some embodiments, the anti-TCRβV antibody molecule, e.g., anti-TCRβ V12 antibody molecule includes at least one, two, or three CDRs according to Chothia et al. (e.g., at least one, two, or three CDRs according to the Chothia definition as set out in Table 2) from a heavy chain variable region of an antibody described herein, e.g., an antibody chosen as described in Table 2, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 2.

In some embodiments, the anti-TCRβV antibody molecule, e.g., anti-TCRβ V12 antibody molecule includes at least one, two, or three CDRs according to Chothia et al. (e.g., at least one, two, or three CDRs according to the Chothia definition as set out in Table 2) from a light chain variable region of an antibody described herein, e.g., an antibody as described in Table 2, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 2.

In some embodiments, the anti-TCRβV antibody molecule, e.g., anti-TCRβ V12 antibody molecule includes at least one, two, three, four, five, or six CDRs according to Chothia et al. (e.g., at least one, two, three, four, five, or six CDRs according to the Chothia definition as set out in Table 2) from the heavy and light chain variable regions of an antibody described herein, e.g., an antibody as described in Table 2, or encoded by the nucleotide sequence in Table 2; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Chothia et al. shown in Table 2.

In some embodiments, the anti-TCRβV antibody molecule, e.g., anti-TCRβ V12 antibody molecule includes all six CDRs according to Chothia et al. (e.g., all six CDRs according to the Chothia definition as set out in Table 2) from the heavy and light chain variable regions of an antibody described herein, e.g., an antibody as described in Table 2, or encoded by the nucleotide sequence in Table 2; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Chothia et al. shown in Table 2. In some embodiments, the anti-TCRβV antibody molecule, e.g., anti-TCRβ V12 antibody molecule may include any CDR described herein.

In some embodiments, the anti-TCRβV antibody molecule, e.g., anti-TCRβ V12 antibody molecule includes at least one, two, or three CDRs according to a combined CDR (e.g., at least one, two, or three CDRs according to the combined CDR definition as set out in Table 2) from a heavy chain variable region of an antibody described herein, e.g., an antibody chosen as described in Table 2, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to combined CDR shown in Table 2.

In some embodiments, the anti-TCRβV antibody molecule, e.g., anti-TCRβ V12 antibody molecule includes at least one, two, or three CDRs according to a combined CDR (e.g., at least one, two, or three CDRs according to the combined CDR definition as set out in Table 2) from a light chain variable region of an antibody described herein, e.g., an antibody as described in Table 2, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to a combined CDR shown in Table 2.

In some embodiments, the anti-TCRβV antibody molecule, e.g., anti-TCRβ V12 antibody molecule includes at least one, two, three, four, five, or six CDRs according to a combined CDR. (e.g., at least one, two, three, four, five, or six CDRs according to the combined CDR definition as set out in Table 2) from the heavy and light chain variable regions of an antibody described herein, e.g., an antibody as described in Table 2, or encoded by the nucleotide sequence in Table 2; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to a combined CDR shown in Table 2.

In some embodiments, the anti-TCRβV antibody molecule, e.g., anti-TCRβ V12 antibody molecule includes all six CDRs according to a combined CDR (e.g., all six CDRs according to the combined CDR definition as set out in Table 2) from the heavy and light chain variable regions of an antibody described herein, e.g., an antibody as described in Table 2, or encoded by the nucleotide sequence in Table 2; or encoded by the nucleotide sequence in Table 2; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to a combined CDR shown in Table 2. In some embodiments, the anti-TCRβV antibody molecule, e.g., anti-TCRβ V12 antibody molecule may include any CDR described herein.

In some embodiments, a combined CDR as set out in Table 1 is a CDR that comprises a Kabat CDR and a Chothia CDR.

In some embodiments, the anti-TCRβV antibody molecule, e e.g., anti-TCRβ V12 antibody molecule, molecule includes a combination of CDRs or hypervariable loops identified as combined CDRs in Table 1. In some embodiments, the anti-TCRβV antibody molecule, e.g., anti-TCRβ V12 antibody molecule, can contain any combination of CDRs or hypervariable loops according the "combined" CDRs are described in Table 1.

In some embodiments, the anti-TCRβV antibody molecule, e.g., anti-TCRβ V12 antibody molecule includes a combination of CDRs or hypervariable loops defined according to the Kabat et al. and Chothia et al., or as described in Table 1 In some embodiments, the anti-TCRβV antibody molecule, e.g., anti-TCRβ V12 antibody molecule can contain any combination of CDRs or hypervariable loops according to the Kabat and Chothia definitions.

In an embodiment, e.g., an embodiment comprising a variable region, a CDR (e.g., a combined CDR, Chothia CDR or Kabat CDR), or other sequence referred to herein, e.g., in Table 2, the antibody molecule is a monospecific antibody molecule, a bispecific antibody molecule, a bivalent antibody molecule, a biparatopic antibody molecule, or an antibody molecule that comprises an antigen binding fragment of an antibody, e.g., a half antibody or antigen binding fragment of a half antibody. In certain embodiments the antibody molecule comprises a multispecific molecule, e.g., a bispecific molecule, e.g., as described herein.

In some embodiments, the anti-TCRβV antibody molecule, e.g., anti-TCRβ V12 antibody molecule includes:
(i) one, two or all of a light chain complementarity determining region 1 (LC CDR1), a light chain complementarity determining region 2 (LC CDR2), and a light chain complementarity determining region 3 (LC CDR3) of SEQ ID NO: 16, SEQ ID NO: 26, SEQ ID NO: 27, SEQ ID NO: 28, SEQ ID NO: 29 or SEQ ID NO: 30, and/or
(ii) one, two or all of a heavy chain complementarity determining region 1 (HC CDR1), heavy chain complementarity determining region 2 (HC CDR2), and a heavy chain complementarity determining region 3 (HC CDR3) of SEQ ID NO: 15, SEQ ID NO: 23, SEQ ID NO: 24 or SEQ ID NO: 25.

In some embodiments, the anti-TCRβV antibody molecule, e.g., anti-TCRβ V12 antibody molecule comprises:
(i) a LC CDR1 amino acid sequence of SEQ ID NO: 20, a LC CDR2 amino acid sequence of SEQ ID NO: 21, or a LC CDR3 amino acid sequence of SEQ ID NO: 22; and/or
(ii) a HC CDR1 amino acid sequence of SEQ ID NO: 17, a HC CDR2 amino acid sequence of SEQ ID NO: 18, or a HC CDR3 amino acid sequence of SEQ ID NO: 19.

In some embodiments, the anti-TCRβV antibody molecule, e.g., anti-TCRβ V12 antibody molecule comprises:
(i) a light chain variable region (VL) comprising a LC CDR1 amino acid sequence of SEQ ID NO: 20, a LC CDR2 amino acid sequence of SEQ ID NO: 21, and a LC CDR3 amino acid sequence of SEQ ID NO: 2; and/or
(ii) a heavy chain variable region (VH) comprising a HC CDR1 amino acid sequence of SEQ ID NO: 17, a HC CDR2 amino acid sequence of SEQ ID NO: 18, and a HC CDR3 amino acid sequence of SEQ ID NO: 19.

In some embodiments, the anti-TCRβV antibody molecule, e.g., anti-TCRβ V12 antibody molecule comprises:
(i) a LC CDR1 amino acid sequence of SEQ ID NO: 63, a LC CDR2 amino acid sequence of SEQ ID NO: 64, or a LC CDR3 amino acid sequence of SEQ ID NO: 65; and/or
(ii) a HC CDR1 amino acid sequence of SEQ ID NO: 57, a HC CDR2 amino acid sequence of SEQ ID NO: 58, or a HC CDR3 amino acid sequence of SEQ ID NO: 59.

In some embodiments, the anti-TCRβV antibody molecule, e.g., anti-TCRβ V12 antibody molecule comprises:
(i) a light chain variable region (VL) comprising a LC CDR1 amino acid sequence of SEQ ID NO: 63, a LC CDR2 amino acid sequence of SEQ ID NO: 64, or a LC CDR3 amino acid sequence of SEQ ID NO: 65; and/or
(ii) a heavy chain variable region (VH) comprising a HC CDR1 amino acid sequence of SEQ ID NO: 57, a HC CDR2 amino acid sequence of SEQ ID NO: 58, or a HC CDR3 amino acid sequence of SEQ ID NO: 59.

In some embodiments, the anti-TCRβV antibody molecule, e.g., anti-TCRβ V12 antibody molecule comprises:
(i) a LC CDR1 amino acid sequence of SEQ ID NO: 66, a LC CDR2 amino acid sequence of SEQ ID NO: 67, or a LC CDR3 amino acid sequence of SEQ ID NO: 68; and/or
(ii) a HC CDR1 amino acid sequence of SEQ ID NO: 60, a HC CDR2 amino acid sequence of SEQ ID NO: 61, or a HC CDR3 amino acid sequence of SEQ ID NO: 62.

In some embodiments, the anti-TCRβV antibody molecule, e.g., anti-TCRβ V12 antibody molecule comprises:
(i) a light chain variable region (VL) comprising a LC CDR1 amino acid sequence of SEQ ID NO: 63, a LC CDR2 amino acid sequence of SEQ ID NO: 64, or a LC CDR3 amino acid sequence of SEQ ID NO: 65; and/or
(ii) a heavy chain variable region (VH) comprising a HC CDR1 amino acid sequence of SEQ ID NO: 57, a HC CDR2 amino acid sequence of SEQ ID NO: 58, or a HC CDR3 amino acid sequence of SEQ ID NO: 59.

In one embodiment, the light or the heavy chain variable framework (e.g., the region encompassing at least FR1, FR2, FR3, and optionally FR4) of the anti-TCRβV antibody molecule, e.g., anti-TCRβ V12 antibody molecule can be chosen from: (a) a light or heavy chain variable framework including at least 80%, 85%, 87% 90%, 92%, 93%, 95%, 97%, 98%, or 100% of the amino acid residues from a human light or heavy chain variable framework, e.g., a light or heavy chain variable framework residue from a human mature antibody, a human germline sequence, or a human consensus sequence; (b) a light or heavy chain variable framework including from 20% to 80%, 40% to 60%, 60% to 90%, or 70% to 95% of the amino acid residues from a human light or heavy chain variable framework, e.g., a light or heavy chain variable framework residue from a human mature antibody, a human germline sequence, or a human consensus sequence; (c) a non-human framework (e.g., a rodent framework); or (d) a non-human framework that has been modified, e.g., to remove antigenic or cytotoxic determinants, e.g., deimmunized, or partially humanized. In one embodiment, the light or heavy chain variable framework region (particularly FR1, FR2 and/or FR3) includes a light or heavy chain variable framework sequence at least 70, 75, 80, 85, 87, 88, 90, 92, 94, 95, 96, 97, 98, 99% identical or identical to the frameworks of a VL or VH segment of a human germline gene.

Figure 2A:
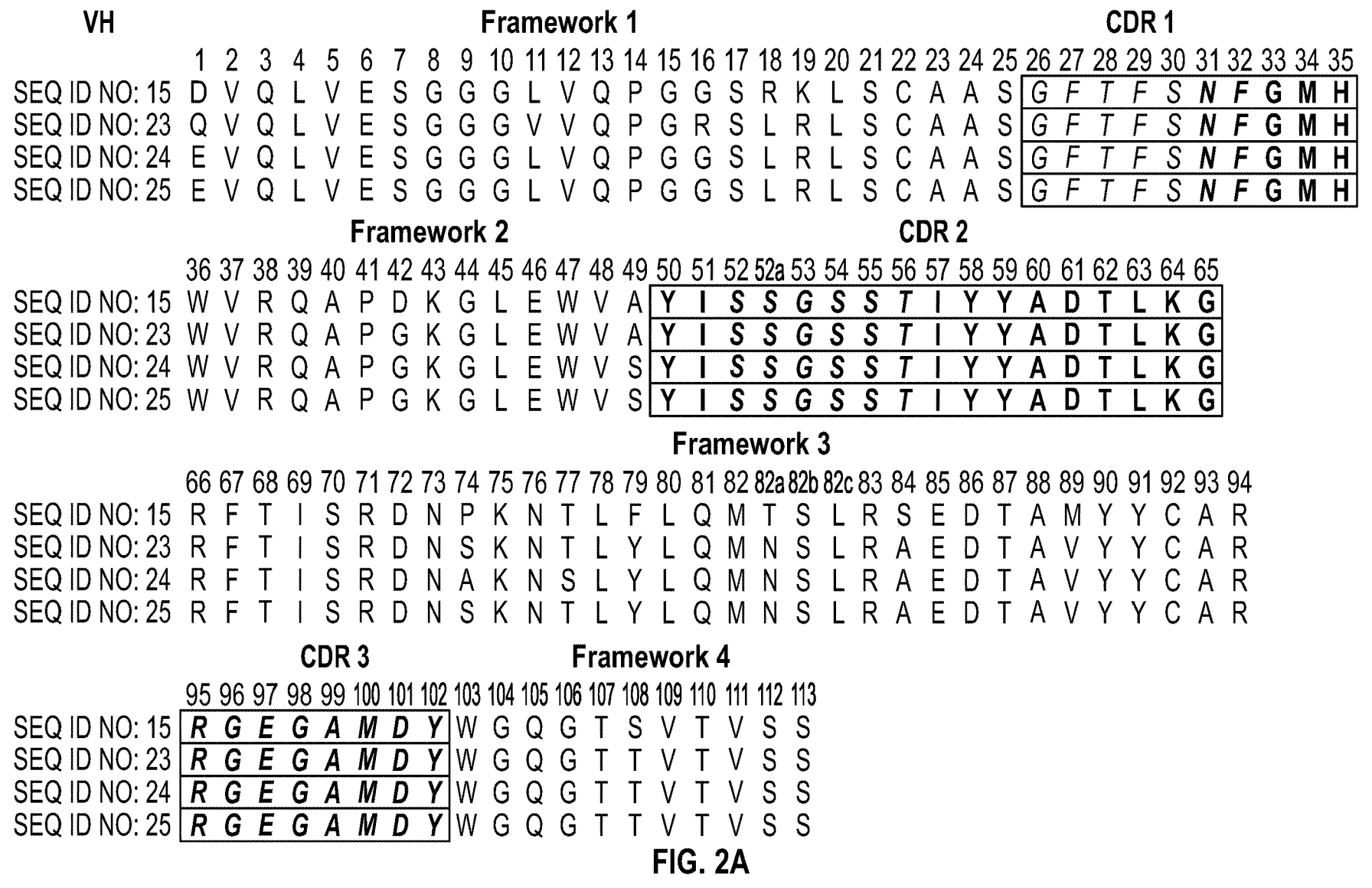

In some embodiments, the anti-TCRβV antibody molecule, e.g., anti-TCRβ V12 antibody molecule, comprises a heavy chain variable domain having at least one, two, three, four, five, six, seven, ten, fifteen, twenty or more changes, e.g., amino acid substitutions or deletions, from an amino acid sequence described in Table 2 e.g., the amino acid sequence of the FR region in the entire variable region, e.g., shown in FIGS. 2A and 2B, or in SEQ ID NOs: 23-25.

Alternatively, or in combination with the heavy chain substitutions described herein the anti-TCRβV antibody molecule, e.g., anti-TCRβ V12 antibody molecule comprises a light chain variable domain having at least one, two, three, four, five, six, seven, ten, fifteen, twenty or more amino acid changes, e.g., amino acid substitutions or deletions, from an amino acid sequence of an antibody described herein e.g., the amino acid sequence of the FR region in the entire variable region, e.g., shown in FIGS. 2A and 2B, or in SEQ ID NOs: 26-30.

In some embodiments, the anti-TCRβV antibody molecule, e.g., anti-TCRβ V12 antibody molecule includes one, two, three, or four heavy chain framework regions shown in FIG. 2A, or a sequence substantially identical thereto.

In some embodiments, the anti-TCRβV antibody molecule, e.g., anti-TCRβ V12 antibody molecule includes one, two, three, or four light chain framework regions shown in FIG. 2B, or a sequence substantially identical thereto.

In some embodiments, the anti-TCRβV antibody molecule, e.g., anti-TCRβ V12 antibody molecule comprises the light chain framework region 1 e.g., as shown in FIG. 2B.

In some embodiments, the anti-TCRβV antibody molecule, e.g., anti-TCRβ V12 antibody molecule comprises the light chain framework region 2 e.g., as shown in FIG. 2B.

In some embodiments, the anti-TCRβV antibody molecule, e.g., anti-TCRβ V12 antibody molecule comprises the light chain framework region 3, e.g., as shown in FIG. 2B.

In some embodiments, the anti-TCRβV antibody molecule, e.g., anti-TCRβ V12 antibody molecule comprises the light chain framework region 4, e.g., as shown in FIG. 2B.

In some embodiments, the anti-TCRβV antibody molecule, e.g., anti-TCRβ V12 antibody molecule comprises a light chain comprising a framework region, e.g., framework region 1 (FR1), comprising a change, e.g., a substitution (e.g., a conservative substitution) at one or more, e.g., all, position disclosed herein according to Kabat numbering. In some embodiments, FR1 comprises an Aspartic Acid at position 1, e.g., a substitution at position 1 according to Kabat numbering, e.g., an Alanine to Aspartic Acid substitution. In some embodiments, FR1 comprises an Asparagine at position 2, e.g., a substitution at position 2 according to Kabat numbering, e.g., an Isoleucine to Asparagine substitution, Serine to Asparagine substitution or Tyrosine to Asparagine substitution. In some embodiments, FR1 comprises a Leucine at position 4, e.g., a substitution at position 4 according to Kabat numbering, e.g., a Methionine to Leucine substitution.

In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, a substitution at position 2 according to Kabat numbering, e.g., an Isoleucine to Asparagine substitution, Serine to Asparagine substitution or Tyrosine to Asparagine substitution, and a substitution at position 4 according to Kabat numbering, e.g., a Methionine to Leucine substitution. In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, and a substitution at position 2 according to Kabat numbering, e.g., an Isoleucine to Asparagine substitution, Serine to Asparagine substitution or Tyrosine to Asparagine substitution. In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, and a substitution at position 4 according to Kabat numbering, e.g., a Methionine to Leucine substitution. In some embodiments, the anti-TCRβV antibody molecule, e.g., anti-TCRβ V12 antibody molecule comprises a light chain comprising a framework region, e.g., framework region 1 (FR1), comprising a substitution at position 2 according to Kabat numbering, e.g., an Isoleucine to Asparagine substitution, Serine to Asparagine substitution or Tyrosine to Asparagine substitution, and a substitution at position 4 according to Kabat numbering, e.g., a Methionine to Leucine substitution. In some embodiments, the substitution is relative to a human germline light chain framework region sequence.

In some embodiments, the anti-TCRβV antibody molecule, e.g., anti-TCRβ V12 antibody molecule comprises a light chain comprising a framework region, e.g., framework region 3 (FR3), comprising a change, e.g., a substitution (e.g., a conservative substitution) at one or more, e.g., all, position disclosed herein according to Kabat numbering. In some embodiments, FR3 comprises a Glycine at position 66, e.g., a substitution at position 66 according to Kabat numbering, e.g., a Lysine to Glycine substitution, or a Serine to Glycine substitution. In some embodiments, FR3 comprises an Asparagine at position 69, e.g., a substitution at position 69 according to Kabat numbering, e.g., a Tyrosine to Asparagine substitution. In some embodiments, FR3 comprises a Tyrosine at position 71, e.g., a substitution at position 71 according to Kabat numbering, e.g., a Phenylalanine to Tyrosine substitution, or an Alanine to Tyrosine substitution.

In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., a Lysine to Glycine substitution, or a Serine to Glycine substitution, and a substitution at position 69 according to Kabat numbering, e.g., a Tyrosine to Asparagine substitution. In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., Lysine to Glycine substitution, or a Serine to Glycine substitution, and a substitution at position 71 according to Kabat numbering, e.g., a Phenylalanine to Tyrosine substitution, or an Alanine to Tyrosine substitution. In some embodiments, the anti-TCRβV antibody molecule, e.g., anti-TCRβ V12 antibody molecule comprises a light chain comprising a framework region, e.g., framework region 3 (FR3), comprising a substitution at position 69 according to Kabat numbering, e.g., a Tyrosine to Asparagine substitution and a substitution at position 71 according to Kabat numbering, e.g., a Phenylalanine to Tyrosine substitution, or an Alanine to Tyrosine substitution. In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., a Lysine to Glycine substitution, or a Serine to Glycine substitution, a substitution at position 69 according to Kabat numbering, e.g., a Tyrosine to Asparagine substitution and a substitution at position 71 according to Kabat numbering, e.g., a Phenylalanine to Tyrosine substitution, or an Alanine to Tyrosine substitution. In some embodiments, the substitution is relative to a human germline light chain framework region sequence.

In some embodiments, the anti-TCRβV antibody molecule, e.g., anti-TCRβ V12 antibody molecule comprises a light chain comprising: a framework region 1 (FR1) comprising a substitution at position 2 according to Kabat numbering, e.g., a Isoleucine to Asparagine substitution; and a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 26. In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 1 according to Kabat numbering, e.g., a Alanine to Aspartic Acid substitution, and a substitution at position 2 according to Kabat numbering, e.g., a Isoleucine to Asparagine substitution; and (b) a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 27 In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Serine to Asparagine substitution; and a substitution at position 4 according to Kabat numbering, e.g., a Methionine to Leucine substitution; and (b) a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 28 In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Serine to Asparagine substitution; and (b) a framework region 3 (FR3) comprising a substitution at position 66 according to Kabat numbering, e.g., a Lysine to Glycine substitution; a substitution at position 69 according to Kabat numbering, e.g., a Threonine to Asparagine substitution; and a substitution at position 71 according to Kabat numbering, e.g., a Alanine to Tyrosine substitution, e.g., as shown in the amino acid sequence of SEQ ID NO: 29. In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Tyrosine to Asparagine substitution; and (b) a framework region 3 (FR3) comprising a substitution at position 66 according to Kabat numbering, e.g., a Serine to Glycine substitution; a substitution at position 69 according to Kabat numbering, e.g., a Threonine to Asparagine substitution; and a substitution at position 71 according to Kabat numbering, e.g., a Alanine to Tyrosine substitution, e.g., as shown in the amino acid sequence of SEQ ID NO: 29. In some embodiments, the substitution is relative to a human germline light chain framework region sequence.

In some embodiments, the anti-TCRβV antibody molecule, e.g., anti-TCRβ V12 antibody molecule comprises a light chain variable domain comprising: (a) a framework region 1 (FR1) comprising a change, e.g., a substitution (e.g., a conservative substitution) at one or more (e.g., all) positions disclosed herein according to Kabat numbering, and (b) a framework region 3 (FR3) comprising a change, e.g., a substitution (e.g., a conservative substitution) at one or more (e.g., all) position disclosed herein according to Kabat numbering. In some embodiments, the substitution is relative to a human germline light chain framework region sequence.

In some embodiments, the anti-TCRβV antibody molecule, e.g., anti-TCRβ V12 antibody molecule comprises the heavy chain framework region 1, e.g., as shown in FIG. 2A.

In some embodiments, the anti-TCRβV antibody molecule, e.g., anti-TCRβ V12 antibody molecule comprises the heavy chain framework region 2, e.g., as shown in FIG. 2A.

In some embodiments, the anti-TCRβV antibody molecule, e.g., anti-TCRβ V12 antibody molecule comprises the heavy chain framework region 3, e.g., as shown in FIG. 2A.

In some embodiments, the anti-TCRβV antibody molecule, e.g., anti-TCRβ V12 antibody molecule comprises the heavy chain framework region 4, e.g., as shown in FIG. 2A.

In some embodiments, the anti-TCRβV antibody molecule, e.g., anti-TCRβ V12 antibody molecule comprises the heavy chain framework regions 1-4, e.g., SEQ ID NOS: 20-23, or as shown in FIG. 2A.

In some embodiments, the anti-TCRβV antibody molecule, e.g., anti-TCRβ V12 antibody molecule comprises the light chain framework regions 1-4, e.g., SEQ ID NOs: 26-30, or as shown in FIG. 2B.

In some embodiments, the anti-TCRβV antibody molecule, e.g., anti-TCRβ V12 antibody molecule comprises the heavy chain framework regions 1-4, e.g., SEQ ID NOs: 23-25; and the light chain framework regions 1-4, e.g., SEQ ID NOs: 26-30, or as shown in FIGS. 2A and 2B.

In some embodiments, the heavy or light chain variable domain, or both, of, the anti-TCRβV antibody molecule, e.g., anti-TCRβ V12 antibody molecule includes an amino acid sequence, which is substantially identical to an amino acid disclosed herein, e.g., at least 80%, 85%, 90%, 92%, 95%, 97%, 98%, 99% or higher identical to a variable region of an antibody described herein, e.g., an antibody as described in Table 2, or encoded by the nucleotide sequence in Table 2; or which differs at least 1 or 5 residues, but less than 40, 30, 20, or 10 residues, from a variable region of an antibody described herein.

In some embodiments, the anti-TCRβV antibody molecule, e.g., anti-TCRβ V12 antibody molecule comprises at least one, two, three, or four antigen-binding regions, e.g., variable regions, having an amino acid sequence as set forth in Table 2, or a sequence substantially identical thereto (e.g., a sequence at least about 85%, 90%, 95%, 99% or more identical thereto, or which differs by no more than 1, 2, 5, 10, or 15 amino acid residues from the sequences shown in Table 2. In another embodiment, the anti-TCRβV antibody molecule, e.g., anti-TCRβ V12 antibody molecule includes a VH and/or VL domain encoded by a nucleic acid having a nucleotide sequence as set forth in Table 2, or a sequence substantially identical thereto (e.g., a sequence at least about 85%, 90%, 95%, 99% or more identical thereto, or which differs by no more than 3, 6, 15, 30, or 45 nucleotides from the sequences shown in Table 2.

In some embodiments, the anti-TCRβV antibody molecule, e.g., anti-TCRβ V12 antibody molecule comprises:
  a VH domain comprising an amino acid sequence chosen from the amino acid sequence of SEQ ID NO: 23, SEQ ID NO:24 or SEQ ID NO:25, an amino acid sequence at least about 85%, 90%, 95%, 99% or more identical to the amino acid sequence SEQ ID NO: 23, SEQ ID NO:24 or SEQ ID NO:25, or an amino acid sequence which differs by no more than 1, 2, 5, 10,
  or 15 amino acid residues from the amino acid sequence of SEQ ID NO: 23, SEQ ID NO:24 or SEQ ID NO:25; and/or a VL domain comprising an amino acid sequence chosen from the amino acid sequence of SEQ ID NO: 26, SEQ ID NO: 27, SEQ ID NO: 28, SEQ ID NO: 29 or SEQ ID NO: 30, an amino acid sequence at least about 85%, 90%, 95%, 99% or more identical to the amino acid sequence of SEQ ID NO: 26, SEQ ID NO: 27, SEQ ID NO: 28, SEQ ID NO: 29 or SEQ ID NO: 30, or an amino acid sequence which differs by no more than 1, 2, 5, 10, or 15 amino acid residues from the amino acid sequence of SEQ ID NO: 26, SEQ ID NO: 27, SEQ ID NO: 28, SEQ ID NO: 29 or SEQ ID NO: 30.

In some embodiments, the anti-TCRβV antibody molecule, e.g., anti-TCRβ V12 antibody molecule comprises:
  a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
  a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:
  a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
  a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:
  a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
  a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:
  a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
  a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:
- a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
- a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule comprises:
- a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and
- a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:
- a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and
- a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule is a full antibody or fragment thereof (e.g., a Fab, F(ab')2, Fv, or a single chain Fv fragment (scFv)). In embodiments, the anti-TCRβV antibody molecule, e.g., anti-TCRβ V6 (e.g., anti-TCRβ V6-5*01) antibody molecule is a monoclonal antibody or an antibody with single specificity. In some embodiments, the anti-TCRβV antibody molecule, e.g., anti-TCRβV12 antibody molecule, can also be a humanized, chimeric, camelid, shark, or an in vitro-generated antibody molecule. In some embodiments, the anti-TCRβV antibody molecule, e.g., anti-TCRβ V12 antibody molecule is a humanized antibody molecule. The heavy and light chains of the anti-TCRβV antibody molecule, e.g., anti-TCRβ V12 antibody molecule can be full-length (e.g., an antibody can include at least one, and preferably two, complete heavy chains, and at least one, and preferably two, complete light chains) or can include an antigen-binding fragment (e.g., a Fab, F(ab')2, Fv, a single chain Fv fragment, a single domain antibody, a diabody (dAb), a bivalent antibody, or bispecific antibody or fragment thereof, a single domain variant thereof, or a camelid antibody).

In some embodiments, the anti-TCRβV antibody molecule, e.g., anti-TCRβ V12 antibody molecule is in the form of a multispecific molecule, e.g., a bispecific molecule, e.g., as described herein.

In some embodiments, the anti-TCRβV antibody molecule, e.g., anti-TCRβ V12 antibody molecule has a heavy chain constant region (Fc) chosen from, e.g., the heavy chain constant regions of IgG1, IgG2, IgG3, IgG4, IgM, IgA1, IgA2, IgD, and IgE. In some embodiments, the Fc region is chosen from the heavy chain constant regions of IgG1, IgG2, IgG3, and IgG4. In some embodiments, the Fc region is chosen from the heavy chain constant region of IgG1 or IgG2 (e.g., human IgG1, or IgG2). In some embodiments, the heavy chain constant region is human IgG1.

In some embodiments, the anti-TCRβV antibody molecule, e.g., anti-TCRβ V12 antibody molecule has a light chain constant region chosen from, e.g., the light chain constant regions of kappa or lambda, preferably kappa (e.g., human kappa). In one embodiment, the constant region is altered, e.g., mutated, to modify the properties of the anti-TCRβV antibody molecule, e.g., anti-TCRβ V12 antibody molecule (e.g., to increase or decrease one or more of: Fc receptor binding, antibody glycosylation, the number of cysteine residues, effector cell function, or complement function). For example, the constant region is mutated at positions 296 (M to Y), 298 (S to T), 300 (T to E), 477 (H to K) and 478 (N to F) to alter Fc receptor binding (e.g., the mutated positions correspond to positions 132 (M to Y), 134 (S to T), 136 (T to E), 313 (H to K) and 314 (N to F) of SEQ ID NOs: 212 or 214; or positions 135 (M to Y), 137 (S to T), 139 (T to E), 316 (H to K) and 317 (N to F) of SEQ ID NOs: 215, 216, 217 or 218).

Antibody B-H.1 comprises a first chain comprising the amino acid sequence of SEQ ID NO: 3280 and a second chain comprising the amino acid sequence of SEQ ID NO: 3281.

TABLE 2

Amino acid and nucleotide sequences for murine and humanized antibody molecules. The antibody molecules include murine mAb Antibody B and humanized mAb Antibody B-H.1. The amino acid the heavy and light chain CDRs, and the amino acid and nucleotide sequences of the heavy and light chain variable regions, and the heavy and light chains are shown.

| Antibody B (murine) | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 57 | HC CDR1 (Kabat) | NFGMH |
| SEQ ID NO: 58 | HC CDR2 (Kabat) | YISSGSSTIYYADTLKG |
| SEQ ID NO: 59 | HC CDR3 (Kabat) | RGEGAMDY |
| SEQ ID NO: 60 | HC CDR1 (Chothia) | GFTFSNF |

TABLE 2-continued

Amino acid and nucleotide sequences for murine and humanized antibody molecules. The antibody molecules include murine mAb Antibody B and humanized mAb Antibody B-H.1. The amino acid the heavy and light chain CDRs, and the amino acid and nucleotide sequences of the heavy and light chain variable regions, and the heavy and light chains are shown.

| | | |
|---|---|---|
| SEQ ID NO: 61 | HC CDR2 (Chothia) | SSGSST |
| SEQ ID NO: 62 | HC CDR3 (Chothia) | RGEGAMDY |
| SEQ ID NO: 15 | VH | DVQLVESGGGLVQPGGSRKLSCAASGF TFSNFGMHWVRQAPDKGLEWVAYISS GSSTIYYADTLKGRFTISRDNPKNTLFL QMTSLRSEDTAMYYCARRGEGAMDY WGQGTSVTVSS |
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 63 | LC CDR1 (Kabat) | RASSSVNYIY |
| SEQ ID NO: 64 | LC CDR2 (Kabat) | YTSNLAP |
| SEQ ID NO: 65 | LC CDR3 (Kabat) | QQFTSSPFT |
| SEQ ID NO: 66 | LC CDR1 (Chothia) | RASSSVNYIY |
| SEQ ID NO: 67 | LC CDR2 (Chothia) | YTSNLAP |
| SEQ ID NO: 68 | LC CDR3 (Chothia) | QQFTSSPFT |
| SEQ ID NO: 16 | VL | ENVLTQSPAIMSASLGEKVTMSCRASSS VNYIYWYQQKSDASPKLWIYYTSNLAP GVPTRFSGSGSGNSYSLTISSMEGEDAA TYYCQQFTSSPFTFGSGTKLEIK |

Antibody B humanized (B-H)
Antibody B-H.1A HC-1

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 3438 | VH | EVOLVESGGGLVQPGGSLRLSCAASGF TFSNFGMHWVRQAPGKGLEWVSYISSG SSTIYYADTLKGRFTISRDNAKNSLYLQ MNSLRAEDTAVYYCARRGEGAMDYW GQGTTVTVSS |
| SEQ ID NO: 31 | DNA VH | GAGGTGCAGCTGGTTGAATCTGGCGG AGGATTGGTTCAGCCTGGCGGCTCTCT GAGACTGTCTTGTGCCGCTTCTGGCTT CACCTTCTCCAACTTCGGCATGCACTG GGTCCGACAGGCCCCTGGAAAAGGAC TGGAATGGGTGTCCTACATCTCCTCCG GCTCCTCCACCATCTACTACGCTGACA CCCTGAAGGGCAGATTCACCATCTCT CGGGACAACGCCAAGAACTCCCTGTA CCTGCAGATGAACAGCCTGAGAGCCG AGGACACCGCCGTGTACTACTGTGCT AGAAGAGGCGAGGGCGCCATGGATTA TTGGGGCCAGGGAACCACAGTGACCG TGTCTAGC |

Antibody B-H.1B HC-2

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 24 | VH | EVQLVESGGGLVQPGGSLRLSCAASGF TFSNFGMHWVRQAPGKGLEWVSYISSG SSTIYYADTLKGRFTISRDNSKNTLYLQ MNSLRAEDTAVYYCARRGEGAMDYW GQGTTVTVSS |
| SEQ ID NO: 32 | DNA VH | GAGGTGCAGCTGGTTGAATCTGGCGG AGGATTGGTTCAGCCTGGCGGCTCTCT GAGACTGTCTTGTGCCGCTTCTGGCTT CACCTTCTCCAACTTCGGCATGCACTG GGTCCGACAGGCCCCTGGAAAAGGAC TGGAATGGGTGTCCTACATCTCCTCCG GCTCCTCCACCATCTACTACGCTGACA CCCTGAAGGGCAGATTCACCATCAGC CGGGACAACTCCAAGAACACCCTGTA CCTGCAGATGAACTCCCTGAGAGCCG AGGACACCGCCGTGTACTACTGTGCT AGAAGAGGCGAGGGCGCCATGGATTA TTGGGGCCAGGGAACCACAGTGACCG TGTCTAGC |

Antibody B-H.1C HC-3

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 25 | VH | QVQLVESGGGVVQPGRSLRLSCAASGF |

TABLE 2-continued

Amino acid and nucleotide sequences for murine and humanized antibody molecules.
The antibody molecules include murine mAb Antibody B and humanized mAb Antibody B-H.1.
The amino acid the heavy and light chain CDRs, and the amino acid and nucleotide sequences of
the heavy and light chain variable regions, and the heavy and light chains are shown.

| | | |
|---|---|---|
| | | TFSNFGMHWVRQAPGKGLEWVAYISS<br>GSSTIYYADTLKGRFTISRDNSKNTLYL<br>QMNSLRAEDTAVYYCARRGEGAMDY<br>WGQGTTVTVSS |
| SEQ ID NO: 33 | DNA VH | CAGGTGCAGCTGGTGGAATCTGGTGG<br>CGGAGTTGTGCAGCCTGGCAGATCCC<br>TGAGACTGTCTTGTGCCGCCTCTGGCT<br>TCACCTTCTCCAACTTCGGCATGCACT<br>GGGTCCGACAGGCCCCTGGAAAAGGA<br>TTGGAGTGGGTCGCCTACATCTCCTCC<br>GGCTCCTCCACCATCTACTACGCTGAC<br>ACCCTGAAGGGCAGATTCACCATCAG<br>CCGGGACAACTCCAAGAACACCCTGT<br>ACCTGCAGATGAACTCCCTGAGAGCC<br>GAGGACACCGCCGTGTACTACTGTGC<br>TAGAAGAGGCGAGGGCGCCATGGATT<br>ATTGGGGCCAGGGAACCACAGTGACC<br>GTGTCTAGC |

Antibody B-H.1D LC-1

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 26 | VL | DNQLTQSPSFLSASVGDRVTITCRASSS<br>VNYIYWYQQKPGKAPKLLIYYTSNLAP<br>GVPSRFSGSGSGNEYTLTISSLOPEDFAT<br>YYCQQFTSSPFTFGQGTKLEIK |
| SEQ ID NO: 34 | DNA VL | GATAACCAGCTGACCCAGTCTCCTAG<br>CTTCCTGTCTGCCTCTGTGGGCGACAG<br>AGTGACAATTACCTGCCGGGCCTCCT<br>CCTCCGTGAACTACATCTACTGGTATC<br>AGCAGAAGCCCGGCAAGGCCCCTAAG<br>CTGCTGATCTACTACACCTCCAATCTG<br>GCCCCTGGCGTGCCCTCTAGATTTTCC<br>GGATCTGGCTCCGGCAACGAGTATAC<br>CCTGACAATCTCCAGCCTGCAGCCTG<br>AGGACTTCGCCACCTACTACTGCCAG<br>CAGTTCACCTCCTCTCCATTCACCTTT<br>GGCCAGGGCACCAAGCTGGAAATCAA<br>A |

Antibody B-H.1E LC-2

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 27 | VL | DNQLTQSPSSLSASVGDRVTITCRASSS<br>VNYIYWYQQKPGKAPKLLIYYTSNLAP<br>GVPSRFSGSGSGNDYTLTISSLQPEDFAT<br>YYCQQFTSSPFTFGQGTKLEIK |
| SEQ ID NO: 35 | DNA VL | ATAACCAGCTGACCCAGTCTCCTTCCA<br>GCCTGTCTGCTTCTGTGGGCGACAGA<br>GTGACAATTACCTGCCGGGCCTCCTCC<br>TCCGTGAACTACATCTACTGGTATCAG<br>CAGAAGCCCGGCAAGGCCCCTAAGCT<br>GCTGATCTACTACACCTCCAATCTGGC<br>CCCTGGCGTGCCCTCTAGATTTTCCGG<br>ATCTGGCTCCGGCAACGACTATACCC<br>TGACAATCTCCAGCCTGCAGCCTGAG<br>GACTTCGCCACCTACTACTGCCAGCA<br>GTTCACCTCCTCTCCATTCACCTTTGG<br>CCAGGGCACCAAGCTGGAAATCAAA |

Antibody B-H.1F LC-3

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 28 | VL | ENVLTQSPATLSVSPGERATLSCRASSS<br>VNYIYWYQQKPGQAPRLLIYYTSNLAP<br>GIPARFSGSGSGNEYTLTISSLQSEDFAV<br>YYCQQFTSSPFTFGQGTKLEIK |
| SEQ ID NO: 36 | DNA VL | GAGAATGTGCTGACCCAGTCTCCTGC<br>CACACTGTCTGTTAGCCCTGGCGAGA<br>GAGCTACCCTGAGCTGCAGAGCCTCT<br>TCCTCCGTGAACTACATCTACTGGTAT<br>CAGCAGAAGCCCGGCCAGGCTCCTAG |

TABLE 2-continued

Amino acid and nucleotide sequences for murine and humanized antibody molecules.
The antibody molecules include murine mAb Antibody B and humanized mAb Antibody B-H.1.
The amino acid the heavy and light chain CDRs, and the amino acid and nucleotide sequences of
the heavy and light chain variable regions, and the heavy and light chains are shown.

|  |  |  |
|---|---|---|
|  |  | ACTGCTGATCTACTACACCTCCAATCT GGCCCCTGGCATCCCTGCCAGATTTTC CGGATCTGGCTCCGGCAACGAGTATA CCCTGACCATCTCCAGCCTGCAGTCCG AGGACTTTGCTGTGTACTATTGCCAGC AGTTCACAAGCAGCCCTTTCACCTTTG GCCAGGGCACCAAGCTGGAAATCAAA |

Antibody B-H.1G LC-4

| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 29 | VL | QNVLTQPPSASGTPGQRVTISCRASSSV NYIYWYQQLPGTAPKLLIYYTSNLAPG VPDRFSGSGSGNSYSLAISGLRSEDEAD YYCQQFTSSPFTFGTGTKVTVL |
| SEQ ID NO: 37 | DNA VL | CAGAATGTGCTGACCCAACCTCCTTCC GCCTCTGGCACACCTGGACAGAGAGT GACAATCTCCTGCCGGGCCTCCTCCTC CGTGAACTACATCTACTGGTATCAGC AGCTGCCCGGCACCGCTCCTAAACTG CTGATCTACTACACCTCCAATCTGGCC CCTGGCGTGCCCGATAGATTTTCCGG ATCTGGCTCCGGCAACTCCTACAGCCT GGCTATCTCTGGCCTGAGATCTGAGG ACGAGGCCGACTACTACTGCCAGCAG TTCACCTCCTCTCCATTCACCTTTGGC ACCGGCACCAAAGTGACAGTTCTT |

Antibody B-H.1H LC-5

| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 30 | VL | SNELTQPPSVSVSPGQTARITCRASSSVN YIYWYQQKSGQAPVLVIYYTSNLAPGIP ERFSGSGSGNMYTLTISGAQVEDEADY YCQQFTSSPFTFGTGTKVTVL |
| SEQ ID NO: 38 | DNA VL | TCTAATGAGCTGACCCAGCCTCCTTCC GTGTCCGTGTCTCCTGGACAGACCGC CAGAATTACCTGCCGGGCCTCCTCCTC CGTGAACTACATCTACTGGTATCAGC AGAAGTCCGGCCAGGCTCCTGTGCTC GTGATCTACTACACCTCCAATCTGGCC CCTGGCATCCCTGAGAGATTCTCCGG ATCTGGCTCCGGCAACATGTACACCC TGACCATCTCTGGCGCCCAGGTGGAA GATGAGGCCGACTACTACTGCCAGCA GTTCACCTCCTCTCCATTCACCTTTGG CACCGGCACCAAAGTGACAGTTCTT |

Antibody B-H.1

| SEQ ID NO: 3280 Chain1: Fc only |  | METDTLLLWVLLLWVPGSTGDKTHTCP PCPAPELLGGPSVFLFPPKPKDTLMISRT PEVTCVVVDVSHEDPEVKFNWYVDGV EVHNAKTKPREEQYNSTYRVVSVLTVL HQDWLNGKEYKCKVSNKALPAPIEKTI SKAKGQPREPQVYTLPPCREEMTKNQV SLWCLVKGFYPSDIAVEWESNGQPENN YKTTPPVLDSDGSFFLYSKLTVDKSRW QQGNVFSCSVMHEALHNRFTQKSLSLS PGK |
| SEQ ID NO: 3281 Chain2: humanized B-H scFv |  | METDTLLLWVLLLWVPGSTGEVQLVES GGGLVQPGGSLRLSCAASGFTFSNFGM HWVRQAPGKGLEWVSYISSGSSTIYYA DTLKGRFTISRDNSKNTLYLQMNSLRA EDTAVYYCARRGEGAMDYWGQGTTV TVSSGGGGSGGGGSGGGGSGGGGSDN QLTQSPSFLSASVGDRVTITCRASSSVN YIYWYQQKPGKAPKLLIYYTSNLAPGV PSRFSGSGSGNEYTLTISSLQPEDFATYY CQQFTSSPFTFGQGTKLEIKGGGGSDKT HTCPPCPAPELLGGPSVFLFPPKPKDTL MISRTPEVTCVVVDVSHEDPEVKFNWY VDGVEVHNAKTKPREEQYNSTYRVVS VLTVLHQDWLNGKEYKCKVSNKALPA |

TABLE 2-continued

Amino acid and nucleotide sequences for murine and humanized antibody molecules. The antibody molecules include murine mAb Antibody B and humanized mAb Antibody B-H.1. The amino acid the heavy and light chain CDRs, and the amino acid and nucleotide sequences of the heavy and light chain variable regions, and the heavy and light chains are shown.

PIEKTISKAKGQPREPQVCTLPPSREEMT
KNQVSLSCAVKGFYPSDIAVEWESNGQ
PENNYKTTPPVLDSDGSFFLVSKLTVDK
SRWQQGNVFSCSVMHEALHNHYTQKS
LSLSPGKGGGGSGGGGSGLNDIFEAQKI
EWHE

TABLE 3

Constant region amino acid sequences of human IgG heavy chains and human kappa light chain

| | | |
|---|---|---|
| Human kappa constant region SEQ ID NO: 39 | LC | RTVAAPSVFI FPPSDEQLKS GTASVVCLLN NFYPREAKVQ WKVDNALQSG NSQESVTEQD SKDSTYSLSS TLTLSKADYE KHKVYACEVT HQGLSSPVTK SFNRGEC |
| IgG4 (S228P) mutant constant region (EU Numbering) SEQ ID NO: 40 | HC | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPPCPAPEFLGGPSVFLFPPKPKDTLMISRTPEV TCVVVDVSQEDPEVQFNWYVDGVEVHNAKTKPREEQFNSTYRVV SVLTVLHQDWLNGKEYKCKVSNKGLPSSIEKTISKAKGQPREPQV YTLPPSQEEMTKNQVSLTCLVKGFYPSDIAVEWESNGQPENNYKT TPPVLDSDGSFFLYSRLTVDKSRWQEGNVFSCSVMHEALHNHYTQ KSLSLSLG |
| IgG1 wild type SEQ ID NO: 41 | HC | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNTK VDKRVEPKSCDKTHTCPPCPAPELLGGPSVFLFPPKPKDTLMISRTP EVTCVVVDVSHEDPEVKFNWYVDGVEVHNAKTKPREEQYNSTYR VVSVLTVLHQDWLNGKEYKCKVSNKALPAPIEKTISKAKGQPREP QVYTLPPSREEMTKNQVSLTCLVKGFYPSDIAVEWESNGQPENNY KTTPPVLDSDGSFFLYSKLTVDKSRWQQGNVFSCSVMHEALHNHY TQKSLSLSPGK |
| IgG1 (N297A) mutant constant region (EU Numbering) SEQ ID NO: 42 | HC | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNTK VDKRVEPKSCDKTHTCPPCPAPELLGGPSVFLFPPKPKDTLMISRTP EVTCVVVDVSHEDPEVKFNWYVDGVEVHNAKTKPREEQYASTYR VVSVLTVLHQDWLNGKEYKCKVSNKALPAPIEKTISKAKGQPREP QVYTLPPSREEMTKNQVSLTCLVKGFYPSDIAVEWESNGQPENNY KTTPPVLDSDGSFFLYSKLTVDKSRWQQGNVFSCSVMHEALHNHY TQKSLSLSPGK |
| IgM constant delta CDC (P311A, P313S) SEQ ID NO: 73 | HC | GSASAPTLFPLVSCENSPSDTSSVAVGCLAQDFLPDSITFSWKYKNN SDISSTRGFPSVLRGGKYAATSQVLLPSKDVMQGTDEHVVCKVQH PNGNKEKNVPLPVIAELPPKVSVFVPPRDGFFGNPRKSKLICQATGF SPRQIQVSWLREGKQVGSGVTTDQVQAEAKESGPTTYKVTSTLTIK ESDWLGQSMFTCRVDHRGLTFQQNASSMCVPDQDTAIRVFAIPPSF ASIFLTKSTKLTCLVTDLTTYDSVTISWTRQNGEAVKTHTNISESHP NATFSAVGEASICEDDWNSGERFTCTVTHTDLASSLKQTISRPKGV ALHRPDVYLLPPAREQLNLRESATITCLVTGFSPADVFVQWMQRG QPLSPEKYVTSAPMPEPQAPGRYFAHSILTVSEEEWNTGETYTCVV AHEALPNRVTERTVDKSTGKPTLYNVSLVMSDTAGTCY |
| IgA1 SEQ ID NO: 74 | HC | ASPTSPKVFPLSLCSTQPDGNVVIACLVQGFFPQEPLSVTWSESGQG VTARNFPPSQDASGDLYTTSSQLTLPATQCLAGKSVTCHVKHYTNP SQDVTVPCPVPSTPPTPSPSTPPTPSPSCCHPRLSLHR- PALEDLLLGSE ANLTCTLTGLRDASGVTFTWTPSSGKSAVQGPPERDLCGCYSVSSV LPGCAEPWNHGKTFTCTAAYPESKTPLTATLSKSGNTFRPEVHLLP PPSEELALNELVTLTCLARGFSPKDVLVRWLQGSQELPREKYLTW ASRQEPSQGTTTFAVTSILRVAAEDWKKGDTFSCMVGHEALPLAF TQKTIDRLAGKPTHVNVSVVMAEVDGTCY |
| IgA2 SEQ ID NO: 75 | HC | ASPTSPKVFPLSLDSTPQDGNVVVACLVQGFFPQEPLSVTWSESGQ NVTARNFPPSQDASGDLYTTSSQLTLPATQCPDGKSVTCHVKHYT NSSQDVTVPCRVPPPPPCCHPRLSLHRPALEDLLLGSEANLTCTLTG LRDASGATFTWTPSSGKSAVQGPPERDLCGCYSVSSVLPGCAQPW NHGETFTCTAAHPELKTPLTANITKSGNTFRPEVHLLPPPSEELALN ELVTLTCLARGFSPKDVLVRWLQGSQELPREKYLTWASRQEPSQG TTTYAVTSILRVAAEDWKKGETFSCMVGHEALPLAFTQKTIDRMA GKPTHINVSVVMAEADGTCY |

TABLE 3-continued

Constant region amino acid sequences of human IgG heavy chains and human kappa light chain

| | | |
|---|---|---|
| Human Ig_J chain HC<br>SEQ ID NO: 76 | | MKNHLLFWGVLAVFIKAVHVKAQEDERIVLVDNKCKCARITSRIIR<br>SSEDPNEDIVERNIRIIVPLNNRENISDPTSPLRTRFVYHLSDLCKKC<br>DPTEVELDNQIVTATQSNICDEDSATETCYTYDRNKCYTAVVPLVY<br>GGETKMVETALTPDACYPD |

Anti-TCRβ V5 Antibodies

Accordingly, in one aspect, the disclosure provides an anti-TCRβV antibody molecule that binds to human TCRβ V5. In some embodiments, the TCRβ V5 subfamily comprises TCRβ V5-5*01, TCRβ V5-6*01, TCRβ V5-4*01, TCRβ V5-8*01, TCRβ V5-1*01, or a variant thereof.

TABLE 10

Amino acid sequences for anti TCRβ V5 antibodies

Murine antibody C

| | | |
|---|---|---|
| SEQ ID NO: 232 | VH | DIQMTQTTSSLSASLGDRVTISCSASQGISNYLNWYQQKP<br>DGTVKLLIYYTSSLHSGVPSRFSGSGSGTDYSLTISNLEPE<br>DIATYYCQQYSKLPRTFGGGTKVEIK |
| SEQ ID NO: 233 | VL | QVQLKESGPGLVAPSQSLSITCTVSGFSLTAYGVNWVRQ<br>PPGKGLEWLGMIWGDGNTDYNSALKSRLSISKDNSKSQV<br>FLKMNSLQTDDTARYYCARDRVTATLYAMDYWGQGTS<br>VTVSS |

Humanized antibody C (C-H antibody)
Variable light chain (VL)

| | | |
|---|---|---|
| SEQ ID NO: 3000 | VL C-H.1 | DIQMTQSPSFLSASVGDRVTITCSASQGISNYLN<br>WYQQKPGKAVKLLIYYTSSLHSGVPSRFSGSG<br>SGTEYTLTISSLQPEDFATYYCQQYSKLPRTFG<br>GGTKVEIK |
| SEQ ID NO: 3001 | VL C-H.2 | DIQMTQSPSSLSASVGDRVTITCSASQGISNYLNW<br>YQQKPGKAVKLLIYYTSSLHSGVPSRFSGSGSGTD<br>YTLTISSLQPEDFATYYCQQYSKLPRTFGGGTKVE<br>IK |
| SEQ ID NO: 3002 | VL C-H.3 | DIQMTQSPSSLSASVGDRVTITCSASQGISNYLNW<br>YQQKPGKVVKLLIYYTSSLHSGVPSRFSGSGSGTD<br>YTLTISSLQPEDVATYYCQQYSKLPRTFGGGTKVE<br>IK |
| SEQ ID NO: 3003 | VL C-H.4 | DIQMTQSPSSLSASVGDRVTITCSASQGISNYLNW<br>YQQKPGQAVKLLIYYTSSLHSGVPSRFSGSGSGTD<br>YTLTISSLQPEDVATYYCQQYSKLPRTFGGGTKVE<br>IK |
| SEQ ID NO: 3004 | VL C-H.5 | DIQMTQSPSSLSASVGDRVTITCSASQGISNYLNW<br>YQQKPGKAVKLLIYYTSSLHSGVPSRFSGSGSGTD<br>YTFTISSLQPEDIATYYCQQYSKLPRTFGGGTKVE<br>IK |
| SEQ ID NO: 3005 | VL C-H.6 | DIQMTQSPSSLSASVGDRVTITCSASQGISNYLNW<br>YQQKPGKTVKLLIYYTSSLHSGIPSRFSGSGSGTD<br>YTLTIRSLQPEDFATYYCQQYSKLPRTFGGGTKVE<br>IK |
| SEQ ID NO: 3006 | VL C-H.7 | AIQMTQSPSSLSASVGDRVTITCSASQGISNYLNW<br>YQQKPGKAVKLLIYYTSSLHSGVPSRFSGSGSGTD<br>YTLTISSLQPEDFATYYCQQYSKLPRTFGGGTKVE<br>IK |
| SEQ ID NO: 3007 | VL C-H.8 | DIQMTQSPSSVSASVGDRVTITCSASQGISNYLNW<br>YQQKPGKAVKLLIYYTSSLHSGVPSRFSGSGSGTD<br>YTLTISSLQPEDFATYYCQQYSKLPRTFGGGTKVE<br>IK |
| SEQ ID NO: 3008 | VL C-H.9 | DIQMTQSPSSLSASVGDRVTITCSASQGISNYLNW<br>YQQKPGKAVKRLIYYTSSLHSGVPSRFSGSGSGTE<br>YTLTISNLQPEDFATYYCQQYSKLPRTFGGGTKVE<br>IK |
| SEQ ID NO: 3009 | VL C-H.10 | AIRMTQSPFSLSASVGDRVTITCSASQGISNYLNW<br>YQQKPAKAVKLFIYYTSSLHSGVPSRFSGSGSGTD<br>YTLTISSLQPEDFATYYCQQYSKLPRTFGGGTKVE<br>IK |
| SEQ ID NO: 3010 | VL C-H.11 | DIQMTQSPSSLSASVGDRVTITCSASQGISNYLNW<br>YQQKPGKAVKRLIYYTSSLHSGVPSRFSGSGSGTE<br>YTLTISSLQPEDFATYYCQQYSKLPRTFGGGTKVE<br>IK |

TABLE 10-continued

| Amino acid sequences for anti TCRβ V5 antibodies | | |
|---|---|---|
| SEQ ID NO: 3011 | VL C-H.12 | DIQMTQSPSTLSASVGDRVTITCSASQGISNYLNW YQQKPGKAVKLLIYYTSSLHSGVPSRFSGSGSGTE YTLTISSLQPDDFATYYCQQYSKLPRTFGGGTKVE IK |
| SEQ ID NO:3012 | VL C-H.13 | DIQMTQSPSSLSASVGDRVTITCSASQGISNYLNW YQQKPGKAVKSLIYYTSSLHSGVPSRFSGSGSGTD YTLTISSLQPEDFATYYCQQYSKLPRTFGGGTKVE IK |
| SEQ ID NO: 3013 | VL C-H.14 | DIQMTQSPSSLSASVGDRVTITCSASQGISNYLNW YQQKPGKAVKSLIYYTSSLHSGVPSKFSGSGSGTD YTLTISSLQPEDFATYYCQQYSKLPRTFGGGTKVE IK |
| SEQ ID NO: 3014 | VL C-H.15 | DIQMTQSPSSLSASVGDRVTITCSASQGISNYLNW YQQKPEKAVKSLIYYTSSLHSGVPSRFSGSGSGTD YTLTISSLQPEDFATYYCQQYSKLPRTFGGGTKVE IK |
| SEQ ID NO: 3015 | VL C-H.16 | DIQMTQSPSAMSASVGDRVTITCSASQGISNYLNW YQQKPGKVVKRLIYYTSSLHSGVPSRFSGSGSGTE YTLTISSLQPEDFATYYCQQYSKLPRTFGGGTKVE IK |
| SEQ ID NO: 3016 | VL C-H.17 | DIVMTQSPDSLAVSLGERATINCSASQGISNYLNW YQQKPGQPVKLLIYYTSSLHSGVPDRFSGSGSGTD YTLTISSLQAEDVAVYYCQQYSKLPRTFGGGTKVE IK |
| SEQ ID NO: 3017 | VL C-H.18 | EIVMTQSPGTLSLSPGERATLSCSASQGISNYLNW YQQKPGQAVKLLIYYTSSLHSGIPDRFSGSGSGTD YTLTISRLEPEDFAVYYCQQYSKLPRTFGGGTKVE IK |
| SEQ ID NO: 3018 | VL C-H.19 | EIVMTQSPPTLSLSPGERVTLSCSASQGISNYLNW YQQKPGQAVKLLIYYTSSLHSGIPARFSGSGSGTD YTLTISSLQPEDFAVYYCQQYSKLPRTFGGGTKVE IK |
| SEQ ID NO: 3019 | VL C-H.20 | EIVMTQSPPTLSLSPGERVTLSCSASQGISNYLNW YQQKPGQAVKLLIYYTSSLHSSIPARFSGSGSGTD YTLTISSLQPEDFAVYYCQQYSKLPRTFGGGTKVE IK |
| SEQ ID NO: 3020 | VL C-H.21 | EIVMTQSPATLSLSPGERATLSCSASQGISNYLNW YQQKPGQAVKLLIYYTSSLHSGIPARFSGSGSGTD YTLTISSLEPEDFAVYYCQQYSKLPRTFGGGTKVE IK |
| SEQ ID NO: 3021 | VL C-H.22 | EIVMTQSPATLSLSPGERATLSCSASQGISNYLNW YQQKPGQAVKLLIYYTSSLHSGIPARFSGSGSGTD YTLTISRLEPEDFAVYYCQQYSKLPRTFGGGTKVE IK |
| SEQ ID NO: 3022 | VL C-H.23 | EIVMTQSPATLSLSPGERATLSCSASQGISNYLNW YQQKPGQAVKLLIYYTSSLHSGIPDRFSGSGSGTD YTLTISRLEPEDFAVYYCQQYSKLPRTFGGGTKVE IK |
| SEQ ID NO: 3023 | VL C-H.24 | EIVMTQSPATLSLSPGERATLSCSASQGISNYLNW YQQKPGLAVKLLIYYTSSLHSGIPDRFSGSGSGTD YTLTISRLEPEDFAVYYCQQYSKLPRTFGGGTKVE IK |
| SEQ ID NO: 3024 | VL C-H.25 | DIQMIQSPSFLSASVGDRVSIICSASQGISNYLNW YLQKPGKSVKLFIYYTSSLHSGVSSRFSGRGSGTD YTLTIISLKPEDFAAYYCQQYSKLPRTFGGGTKVE IK |
| SEQ ID NO: 3025 | VL C-H.26 | EIVMTQSPATLSLSPGERATLSCSASQGISNYLNW YQQKPGQAVKLLIYYTSSLHSGIPARFSGSGSGTD YTLTISSLQPEDFAVYYCQQYSKLPRTFGGGTKVE IK |
| SEQ ID NO: 3026 | VL C-H.27 | EIVMTQSPATLSLSPGERATLSCSASQGISNYLNW YQQKPGQAVKLLIYYTSSLHSGIPARFSGSGPGTD YTLTISSLEPEDFAVYYCQQYSKLPRTFGGGTKVE IK |
| SEQ ID NO: 3027 | VL C-H.28 | DIVMTQTPLSLSVTPGQPASISCSASQGISNYLNW YLQKPGQSVKLLIYYTSSLHSGVPDRFSGSGSGTD YTLKISRVEAEDVGVYYCQQYSKLPRTFGGGTKVE IK |
| SEQ ID NO: 3028 | VL C-H.29 | DIVMTQTPLSLSVTPGQPASISCSASQGISNYLNW YLQKPGQPVKLLIYYTSSLHSGVPDRFSGSGSGTD YTLKISRVEAEDVGVYYCQQYSKLPRTFGGGTKVE IK |

TABLE 10-continued

| Amino acid sequences for anti TCRβ V5 antibodies | | |
|---|---|---|
| SEQ ID NO: 3029 | VL C-H.30 | DIVMTQSPAFLSVTPGEKVTITCSASQGISNYLNWYQQKPDQAVKLLIYYTSSLHSGVPSRFSGSGSGTDYTFTISSLEAEDAATYYCQQYSKLPRTFGGGTKVEIK |
| SEQ ID NO: 3030 | VL C-H.31 | DIVMTQSPLSLPVTPGEPASISCSASQGISNYLNWYLQKPGQSVKLLIYYTSSLHSGVPDRFSGSGSGTDYTLKISRVEAEDVGVYYCQQYSKLPRTFGGGTKVEIK |
| SEQ ID NO: 3031 | VL C-H.32 | DIVMTQTPLSLPVTPGEPASISCSASQGISNYLNWYLQKPGQSVKLLIYYTSSLHSGVPDRFSGSGSGTDYTLKISRVEAEDVGVYYCQQYSKLPRTFGGGTKVEIK |
| SEQ ID NO: 3032 | VL C-H.33 | EIVMTQSPATLSVSPGERATLSCSASQGISNYLNWYQQKPGQAVKLLIYYTSSLHSGIPARFSGSGSGTEYTLTISILQSEDFAVYYCQQYSKLPRTFGGGTKVEIK |
| SEQ ID NO: 3033 | VL C-H.34 | EIVMTQSPATLSVSPGERATLSCSASQGISNYLNWYQQKPGQAVKLLIYYTSSLHSGIPARFSGSGSGTEYTLTISSLQSEDFAVYYCQQYSKLPRTFGGGTKVEIK |
| SEQ ID NO: 3034 | VL C-H.35 | DIVMTQSPLSLPVTLGQPASISCSASQGISNYLNWYQQRPGQSVKRLIYYTSSLHSGVPDRFSGSGSGTDYTLKISRVEAEDVGVYYCQQYSKLPRTFGGGTKVEIK |
| SEQ ID NO: 3035 | VL C-H.36 | EITMTQSPAFMSATPGDKVNISCSASQGISNYLNWYQQKPGEAVKFIIYYTSSLHSGIPPRFSGSGYGTDYTLTINNIESEDAAYYCQQYSKLPRTFGGGTKVEIK |
| SEQ ID NO: 3036 | VL C-H.37 | DIVMTQTPLSSPVTLGQPASISCSASQGISNYLNWYQQRPGQPVKLLIYYTSSLHSGVPDRFSGSGAGTDYTLKISRVEAEDVGVYYCQQYSKLPRTFGGGTKVEIK |
| SEQ ID NO: 3037 | VL C-H.38 | EIVMTQSPDFQSVTPKEKVTITCSASQGISNYLNWYQQKPDQSVKLLIYYTSSLHSGVPSRFSGSGSGTDYTLTINSLEAEDAATYYCQQYSKLPRTFGGGTKVEIK |
| SEQ ID NO: 3038 | VL C-H.39 | EIVMTQTPLSLSITPGEQASISCSASQGISNYLNWYLQKARPVVKLLIYYTSSLHSGVPDRFSGSGSGTDYTLKISRVEAEDFGVYYCQQYSKLPRTFGGGTKVEIK |
| SEQ ID NO: 3039 | VL C-H.40 | EIVMTQTPLSLSITPGEQASMSCSASQGISNYLNWYLQKARPVVKLLIYYTSSLHSGVPDRFSGSGSGTDYTLKISRVEAEDFGVYYCQQYSKLPRTFGGGTKVEIK |
| | | Variable HEAVY chain (VH) |
| SEQ ID NO: 3040 | VH C-H.1 | QVTLKESGPVLVKPTETLTLTCTVSGFSLTAYGVNWVRQPPGKALEWLGMIWGDGNTDYNSALKSRLTISKDNSKSQVVLTMTNMDPVDTATYYCARDRVTATLYAMDYWGQGTLVTVSS |
| SEQ ID NO: 3041 | VH C-H.2 | QVTLKESGPALVKPTETLTLTCTVSGFSLTAYGVNWVRQPPGKALEWLGMIWGDGNTDYNSALKSRLIISKDNSKSQVVLTMTNMDPVDTATYYCARDRVTATLYAMDYWGQGTLVTVSS |
| SEQ ID NO: 3042 | VH C-H.3 | QVTLKESGPALVKPTQTLTLTCTVSGFSLTAYGVNWVRQPPGKALEWLGMIWGDGNTDYNSALKSRLTISKDNSKSQVVLTMTNMDPVDTATYYCARDRVTATLYAMDYWGQGTLVTVSS |
| SEQ ID NO: 3043 | VH C-H.4 | QVQLQESGPGLVKPSGTLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3044 | VH C-H.5 | QVTLKESGPTLVKPTQTLTLTCTVSGFSLTAYGVNWVRQPPGKALEWLGMIWGDGNTDYNSALKSRLTITKDNSKSQVVLTMTNMDPVDTATYYCARDRVTATLYAMDYWGQGTLVTVSS |
| SEQ ID NO: 3045 | VH C-H.6 | QVTLKESGPALVKPTQTLTLTCTVSGFSLTAYGVNWVRQPPGKALEWLGMIWGDGNTDYNSALKSRLTITKDNSKSQVVLTMTNMDPVDTATYYCARDRVTATLYAMDYWGQGTLVTVSS |
| SEQ ID NO: 3046 | VH C-H.7 | QVQLQESGPGLVKPSQTLSLTCTVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3047 | VH C-H.8 | QVQLQESGPGLVKPSETLSLTCTVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |

TABLE 10-continued

| | Amino acid sequences for anti TCRβ V5 antibodies |
|---|---|
| SEQ ID NO: 3048 VH C-H.9 | QVQLQESGPGLVKPSQTLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3049 VH C-H.10 | QVQLQESGPGLVKPSDTLSLTCTVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3050 VH C-H.11 | QVQLQESGPGLVKPSQTLSLTCTVSGFSLTAYGVNWVRQHPGKGLEWLGMIWGDGNTDYNSALKSRLTISKDNSKSQVSLKLSSVTAADTAVYYCARDRVTATLYAMDYWGQGTLVTVSS |
| SEQ ID NO: 3051 VH C-H.12 | QVQLQESGPGLVKPSQTLSLTCTVSGFSLTAYGVNWVRQPAGKGLEWLGMIWGDGNTDYNSALKSRLTISKDNSKSQVSLKLSSVTAADTAVYYCARDRVTATLYAMDYWGQGTLVTVSS |
| SEQ ID NO: 3052 VH C-H.13 | QVQLQESGPGLVKPSQTLSLTCAVSGFSLTAYGVNWVRQPPGKGLEWLGMIWGDGNTDYNSALKSRLTISKDNSKSQVSLKLSSVTAVDTAVYYCARDRVTATLYAMDYWGQGTLVTVSS |
| SEQ ID NO: 3053 VH C-H.14 | QVQLQESGPGLVKPSETLSLTCTVSGFSLTAYGVNWVRQPPGKGLEWLGMIWGDGNTDYNSALKSRLTISKDNSKSHVSLKLSSVTAADTAVYYCARDRVTATLYAMDYWGQGTLVTVSS |
| SEQ ID NO: 3054 VH C-H.15 | QVQLQESGPGLVKPSETLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3055 VH C-H.16 | QVQLQESGPGLVKPSQTLSLTCAVYGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3056 VH C-H.17 | RVQLQESGPGLVKPSETLSLTCTVSGFSLTAYGVNWVRQPPGKGLEWLGMIWGDGNTDYNSALKSRLTISKDNSKSQVPLKLSSVTAADTAVYYCARDRVTATLYAMDYWGQGTLVTVSS |
| SEQ ID NO: 3057 VH C-H.18 | QVQLQESGPGLVKPSQTLSLTCTVSGFSLTAYGVNWVRQHPGKGLEWLGMIWGDGNTDYNSALKSLLTISKDNSKSQVSLKLSSVTAADTAVYYCARDRVTATLYAMDYWGQGTLVTVSS |
| SEQ ID NO: 3058 VH C-H.19 | QVQLQESGPGLVKPSDTLSLTCAVSGFSLTAYGVNWVRQPPGKGLEWLGMIWGDGNTDYNSALKSRLTISKDNSKSQVSLKLSSVTALDTAVYYCARDRVTATLYAMDYWGQGTLVTVSS |
| SEQ ID NO: 3059 VH C-H.20 | QVQLQESGPGLVKPSDTLSLTCAVSGFSLTAYGVNWVRQPPGKGLEWLGMIWGDGNTDYNSALKSRLTISKDNSKSQVSLKLSSVTAVDTAVYYCARDRVTATLYAMDYWGQGTLVTVSS |
| SEQ ID NO: 3060 VH C-H.21 | QVQLQESGSGLVKPSQTLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS |
| SEQ ID NO: 3061 VH C-H.22 | EVQLVESGGGLVQPGRSLRLSCTVSGFSLTAYGVNWVRQAPGKGLEWLGMIWGDGNTDYNSALKSRLTISKDNSKSIVYLQMNSLKTEDTAVYYCARDRVTATLYAMDYWGQGTLVTVSS |
| SEQ ID NO: 3062 VH C-H.23 | EVQLVESGGGLVQPGPSLRLSCTVSGFSLTAYGVNWVRQAPGKGLEWLGMIWGDGNTDYNSALKSRLTISKDNSKSIVYLQMNSLKTEDTAVYYCARDRVTATLYAMDYWGQGTLVTVSS |
| SEQ ID NO: 3063 VH C-H.24 | QVQLQESGSGLVKPSQTLSLTCAVSGFSLTAYGVNWVRQSPGKGLEWLGMIWGDGNTDYNSALKSRLTISKDNSKSQVSLKLSSVTAADTAVYYCARDRVTATLYAMDYWGQGTLVTVSS |
| SEQ ID NO: 3064 VH C-H.25 | QVQLQESGPGLVKPSETLSLTCTVSGFSLTAYGVNWVRQPAGKGLEWLGMIWGDGNTDYNSALKSRLTISKDNSKSQVSLKLSSVTAADTAVYYCARDRVTATLYAMDYWGQGTLVTVSS |
| SEQ ID NO: 3065 VH C-H.26 | EVQLVESGGGLVKPGRSLRLSCTVSGFSLTAYGVNWVRQAPGKGLEWLGMIWGDGNTDYNSALKSRLTISKDNSKSIVYLQMNSLKTEDTAVYYCARDRVTATLYAMDYWGQGTLVTVSS |

TABLE 10-continued

| Amino acid sequences for anti TCRβ V5 antibodies | | |
|---|---|---|
| SEQ ID NO: 3066 | VH C-H.27 | QVQLQESGPGLVKPSETLSLTCAVYGFSLTAYGVN WVRQPPGKGLEWLGMIWGDGNTDYNSALKSRLTIS KDNSKSQVYLKLSSVTAADTAVYYCARDRVTATLY AMDYWGQGTLVTVSS |
| SEQ ID NO: 3067 | VH C-H.28 | QVQLQESGPGLVKPSDTLSLTCAVSGFSLTAYGVN WVRQPPGKGLEWLGMIWGDGNTDYNSALKSRLTIS KDNSKSQVSLKLSSVTAVDTGVYYCARDRVTATLY AMDYWGQGTLVTVSS |
| SEQ ID NO: 3068 | VH C-H.29 | EVQLVESGGGLVQPGGSLRLSCAVSGFSLTAYGVN WVRQAPGKGLEWLGMIWGDGNTDYNSALKSRLTIS KDNSKSSVYLQMNSLKTEDTAVYYCARDRVTATLY AMDYWGQGTLVTVSS |
| SEQ ID NO: 3069 | VH C-H.30 | EVQLVESGGGLVKPGGSLRLSCAVSGFSLTAYGVN WVRQAPGKGLEWLGMIWGDGNTDYNSALKSRLTIS KDNSKSTVYLQMNSLKTEDTAVYYCARDRVTATLY AMDYWGQGTLVTVSS |
| SEQ ID NO: 3070 | VH C-H.31 | QVQLQQSGPGLVKPSQTLSLTCAVSGFSLTAYGVN WVRQSPSRGLEWLGMIWGDGNTDYNSALKSRLTIN KDNSKSQVSLQLNSVTPEDTAVYYCARDRVTATLY AMDYWGQGTLVTVSS |
| SEQ ID NO: 3071 | VH C-H.32 | QVQLVESGGGLVQPGGSLRLSCSVSGFSLTAYGVN WVRQAPGKGLEWLGMIWGDGNTDYNSALKSRLTIS KDNSKSTVYLQMNSLRAEDTAVYYCARDRVTATLY AMDYWGQGTLVTVSS |
| SEQ ID NO: 3072 | VH C-H.33 | QVQLQQWGAGLLKPSETLSLTCAVYGFSLTAYGVN WVRQPPGKGLEWLGMIWGDGNTDYNSALKSRLTIS KDNSKSQVSLKLSSVTAADTAVYYCARDRVTATLY AMDYWGQGTLVTVSS |
| SEQ ID NO: 3073 | VH C-H.34 | QVQLVESGGGVVQPGRSLRLSCAVSGFSLTAYGVN WVRQAPGKGLEWLGMIWGDGNTDYNSALKSRLTIS KDNSTSTVFLQMNSLRAEDTAVYYCARDRVTATLY AMDYWGQGTLVTVSS |
| SEQ ID NO: 3074 | VH C-H.35 | EVQLVESGGGLVQPGGSLRLSCAVSGFSLTAYGVN WVRQAPGKGLEWLGMIWGDGNTDYNSALKSRLTIS KDNSKSTVYLQMNSLRAEDTAVYYCARDRVTATLY AMDYWGQGTLVTVSS |
| SEQ ID NO: 3075 | VH C-H.36 | EVQLVESGGGLVQPGGSLRLSCAVSGFSLTAYGVN WVRQAPGKGLEWLGMIWGDGNTDYNSALKSRLTIS KDNAKSSVYLQMNSLRDEDTAVYYCARDRVTATLY AMDYWGQGTLVTVSS |
| SEQ ID NO: 3076 | VH C-H.37 | EVQLLESGGGLVQPGGSLRLSCAVSGFSLTAYGVN WVRQAPGKGLEWLGMIWGDGNTDYNSALKSRLTIS KDNSKSTVYLQMNSLRAEDTAVYYCARDRVTATLY AMDYWGQGTLVTVSS |
| SEQ ID NO: 3077 | VH C-H.38 | QVQLVESGGGLVKPGGSLRLSCAVSGFSLTAYGVN WVRQAPGKGLEWLGMIWGDGNTDYNSALKSRLTIS KDNAKSSVYLQMNSLRAEDTAVYYCARDRVTATLY AMDYWGQGTLVTVSS |
| SEQ ID NO: 3078 | VH C-H.39 | EVQLVESGGGLVQPGGSLKLSCAVSGFSLTAYGVN WVRQASGKGLEWLGMIWGDGNTDYNSALKSRLTIS KDNSKSTVYLQMNSLKTEDTAVYYCARDRVTATLY AMDYWGQGTLVTVSS |
| SEQ ID NO: 3079 | VH C-H.40 | QVQLLESGGGLVKPGGSLRLSCAVSGFSLTAYGVN WVRQAPGKGLEWLGMIWGDGNTDYNSALKSRLTIS KDNAKSSVYLQMNSLRAEDTAVYYCARDRVTATLY AMDYWGQGTLVTVSS |
| SEQ ID NO: 3080 | VH C-H.41 | QVQLVESGGGVVQPGRSLRLSCAVSGFSLTAYGVN WVRQAPGKGLEWLGMIWGDGNTDYNSALKSRLTIS KDNSKSTVYLQMNSLRAEDTAVYYCARDRVTATLY AMDYWGQGTLVTVSS |
| SEQ ID NO: 3081 | VH C-H.42 | QVQLVESGGGVVQPGRSLRLSCAVSGFSLTAYGVN WVRQAPGKGLEWLGMIWGDGNTDYNSALKSRLTIS KDNSKSRVYLQMNSLRAEDTAVYYCARDRVTATLY AMDYWGQGTLVTVSS |
| SEQ ID NO: 3082 | VH C-H.43 | QVQLVESGGGVVQPGRSLRLSCAVSGFSLTAYGVN WVRQAPGKGLEWLGMIWGDGNTDYNSALKSRLAIS KDNSKSTVYLQMNSLRAEDTAVYYCARDRVTATLY AMDYWGQGTLVTVSS |
| SEQ ID NO: 3083 | VH C-H.44 | QVQLVESGGGVVQPGGSLRLSCAVSGFSLTAYGVN WVRQAPGKGLEWLGMIWGDGNTDYNSALKSRLTIS KDNSKSTVYLQMNSLRAEDTAVYYCARDRVTATLY AMDYWGQGTLVTVSS |

TABLE 10-continued

Amino acid sequences for anti TCRβ V5 antibodies

SEQ ID NO: 3084 VH C-H.45 EVOLVESGGGLVQPGGSLRLSCAVSGFSLTAYGVN
WVRQAPGKGLEWLGMIWGDGNTDYNSALKSRLTIS
KDNAKSTVYLQMNSLRAEDTAVYYCARDRVTATLY
AMDYWGQGTLVTVSS

SEQ ID NO: 3085 VH C-H.46 EVOLVESGGGLVQPGGSLRLSCAVSGFSLTAYGVN
WVRQAPGKGLEWLGMIWGDGNTDYNSALKSRLTIS
KDNAKSSVYLQMNSLRAEDTAVYYCARDRVTATLY
AMDYWGQGTLVTVSS

SEQ ID NO: 3086 VH C-H.47 EVOLVESGGVVVQPGGSLRLSCAVSGFSLTAYGVN
WVRQAPGKGLEWLGMIWGDGNTDYNSALKSRLTIS
KDNSKSSVYLQMNSLRTEDTALYYCARDRVTATLY
AMDYWGQGTLVTVSS

SEQ ID NO: 3087 VH C-H.48 EVOLVESGGGLVQPGGSLRLSCAVSGFSLTAYGVN
WVRQAPGKGLEWLGMIWGDGNTDYNSALKSRLTIS
KHNSKSTVYLQMNSLRAEDTAVYYCARDRVTATLY
AMDYWGQGTLVTVSS

SEQ ID NO: 3088 VH C-H.49 EVOLVESGGGLVKPGGSLRLSCAVSGFSLTAYGVN
WVRQAPGKGLEWLGMIWGDGNTDYNSALKSRLTIS
KDNAKSSVYLQMNSLRAEDTAVYYCARDRVTATLY
AMDYWGQGTLVTVSS

SEQ ID NO: 3089 VH C-H.50 EVOLVESGGGLIQPGGSLRLSCAVSGFSLTAYGVN
WVRQPPGKGLEWLGMIWGDGNTDYNSALKSRLTIS
KDNSKSTVYLQMNSLRAEDTAVYYCARDRVTATLY
AMDYWGQGTLVTVSS

Antibody E comprises a heavy chain comprising the amino acid sequence of SEQ ID NO: 3284 and a light chain comprising the amino acid sequence of SEQ ID NO: 3285.

TABLE 11

Amino acid sequences for anti TCRβ V5 antibodies

Murine antibody E

SEQ ID NO: 3091 VH QVQLQQSGPELVKPGASVKISCKASGYAFSSSWMNWVK
QRPGQGLEWIGRIYPGDGDTKYNGKFKGKATLTADKSSS
TAYMHLSSLTSVDSAVYFCARRGTGGWYFDVWGAGTT
VTVSS

SEQ ID NO: 3284 Heavy chain METDTLLLWVLLLWVPGSTGQVQLQQSGPELVKPGASV
KISCKASGYAFSSSWMNWVKQRPGQGLEWIGRIYPGDG
DTKYNGKFKGKATLTADKSSSTAYMHLSSLTSVDSAVYF
CARRGTGGWYFDVWGAGTTVTVSSAKTTAPSVYPLAPV
CGDTTGSSVTLGCLVKGYFPEPVTLTWNSGSLSSGVHTFP
AVLQSDLYTLSSSVTVTSSTWPSQSITCNVAHPASSTKVD
KKIEPRGPTIKPCPPCKCPAPNLLGGPSVFIFPPKIKDVLMI
SLSPIVTCVVVDVSEDDPDVQISWFVNNVEVHTAQTQTH
REDYNSTLRVVSALPIQHQDWMSGKEFKCKVNNKDLPA
PIERTISKPKGSVRAPQVYVLPPPEEEMTKKQVTLTCMVT
DFMPEDIYVEWTNNGKTELNYKNTEPVLDSDGSYFMYS
KLRVEKKNWVERNSYSCSVVHEGLHNHHTTKSFSRTPG
K SEQ ID NO: 3092 VL DIVLTQSPASLAVSLGQRATISCRASESVDSSGNSFMHWY
QQKPGQPPQLLIYRASNLESGIPARFSGSGSRTDFTLTINP
VEADDVATFYCQQSFDDPFTFGSGTKLEIK SEQ ID NO: 3285 Light chain METDTLLLWVLLLWVPGSTGDIVLTQSPASLAVSLGQRA
TISCRASESVDSSGNSFMHWYQQKPGQPPQLLIYRASNLE
SGIPARFSGSGSRTDFTLTINPVEADDVATFYCQQSFDDPF
TFGSGTKLEIKRADAAPTVSIFPPSSEQLTSGGASVVCFLN
NFYPKDINVKWKIDGSERQNGVLNSWTDQDSKDSTYSM
SSTLTLTKDEYERHNSYTCEATHKTSTSPIVKSFNRNEC Humanized antibody E (E-H antibody)
Variable light chain (VL)

SEQ ID NO: 3093 VL E-H.1 DIVLTQSPDSLAVSLGERATINCRASESVDSSGNS
FMHWYQQKPGQPPQLLIYRASNLESGVPDRFSGSG
SRTDFTLTISSLQAEDVAVYYCQQSFDDPFTFGQG
TKLEIK

SEQ ID NO: 3094 VL E-H.2 EIVLTQSPATLSLSPGERATLSCRASESVDSSGNS
FMHWYQQKPGQAPQLLIYRASNLESGIPARFSGSG
SRTDFTLTISSLEPEDFAVYYCQQSFDDPFTFGQG
TKLEIK

TABLE 11-continued

| Amino acid sequences for anti TCRβ V5 antibodies | | |
|---|---|---|
| SEQ ID NO: 3095 VL | E-H.3 | EIVLTQSPATLSLSPGERATLSCRASESVDSSGNS<br>FMHWYQQKPGQAPQLLIYRASNLESGIPARFSGSG<br>SRTDFTLTISRLEPEDFAVYYCQQSFDDPFTFGQG<br>TKLEIK |
| SEQ ID NO: 3096 VL | E-H.4 | EIVLTQSPATLSLSPGERATLSCRASESVDSSGNS<br>FMHWYQQKPGQAPQLLIYRASNLESGIPARFSGSG<br>SRTDFTLTISSLQPEDFAVYYCQQSFDDPFTFGQG<br>TKLEIK |
| SEQ ID NO: 3097 VL | E-H.5 | DIQLTQSPSSLSASVGDRVTITCRASESVDSSGNS<br>FMHWYQQKPGQAPQLLIYRASNLESGVPSRFSGSG<br>SRTDFTLTISSLQPEDVATYYCQQSFDDPFTFGQG<br>TKLEIK |
| SEQ ID NO: 3098 VL | E-H.6 | EIVLTQSPATLSLSPGERATLSCRASESVDSSGNS<br>FMHWYQQKPGQAPQLLIYRASNLESGIPARFSGSG<br>PRTDFTLTISSLEPEDFAVYYCQQSFDDPFTFGQG<br>TKLEIK |
| SEQ ID NO: 3099 VL | E-H.7 | EIVLTQSPATLSLSPGERATLSCRASESVDSSGNS<br>FMHWYQQKPGQAPQLLIYRASNLESGIPDRFSGSG<br>SRTDFTLTISRLEPEDFAVYYCQQSFDDPFTFGQG<br>TKLEIK |
| SEQ ID NO: 3100 VL | E-H.8 | DIQLTQSPSSLSASVGDRVTITCRASESVDSSGNS<br>FMHWYQQKPGKVPQLLIYRASNLESGVPSRFSGSG<br>SRTDFTLTISSLQPEDVATYYCQQSFDDPFTFGQG<br>TKLEIK |
| SEQ ID NO: 3101 VL | E-H.9 | DIQLTQSPSSLSASVGDRVTITCRASESVDSSGNS<br>FMHWYQQKPGKTPQLLIYRASNLESGIPSRFSGSG<br>SRTDFTLTIRSLQPEDFATYYCQQSFDDPFTFGQG<br>TKLEIK |
| SEQ ID NO: 3102 VL | E-H.10 | EIVLTQSPGTLSLSPGERATLSCRASESVDSSGNS<br>FMHWYQQKPGQAPQLLIYRASNLESGIPDRFSGSG<br>SRTDFTLTISRLEPEDFAVYYCQQSFDDPFTFGQG<br>TKLEIK |
| SEQ ID NO: 3103 VL | E-H.11 | EIVLTQSPATLSLSPGERATLSCRASESVDSSGNS<br>FMHWYQQKPGLAPQLLIYRASNLESGIPDRFSGSG<br>SRTDFTLTISRLEPEDFAVYYCQQSFDDPFTFGQG<br>TKLEIK |
| SEQ ID NO: 3104 VL | E-H.12 | DIQLTQSPSSLSASVGDRVTITCRASESVDSSGNS<br>FMHWYQQKPGKAPQLLIYRASNLESGVPSRFSGSG<br>SRTDFTLTISSLQPEDFATYYCQQSFDDPFTFGQG<br>TKLEIK |
| SEQ ID NO: 3105 VL | E-H.13 | DIQLTQSPSSVSASVGDRVTITCRASESVDSSGNS<br>FMHWYQQKPGKAPQLLIYRASNLESGVPSRFSGSG<br>SRTDFTLTISSLQPEDFATYYCQQSFDDPFTFGQG<br>TKLEIK |
| SEQ ID NO: 3106 VL | E-H.14 | AIQLTQSPSSLSASVGDRVTITCRASESVDSSGNS<br>FMHWYQQKPGKAPQLLIYRASNLESGVPSRFSGSG<br>SRTDFTLTISSLQPEDFATYYCQQSFDDPFTFGQG<br>TKLEIK |
| SEQ ID NO: 3107 VL | E-H.15 | DIQLTQSPSFLSASVGDRVTITCRASESVDSSGNS<br>FMHWYQQKPGKAPQLLIYRASNLESGVPSRFSGSG<br>SRTEFTLTISSLQPEDFATYYCQQSFDDPFTFGQG<br>TKLEIK |
| SEQ ID NO: 3108 VL | E-H.16 | DIQLTQSPSSLSASVGDRVTITCRASESVDSSGNS<br>FMHWYQQKPGKAPQLLIYRASNLESGVPSRFSGSG<br>SRTDFTFTISSLQPEDIATYYCQQSFDDPFTFGQG<br>TKLEIK |
| SEQ ID NO: 3109 VL | E-H.17 | EIVLTQSPATLSVSPGERATLSCRASESVDSSGNS<br>FMHWYQQKPGQAPQLLIYRASNLESGIPARFSGSG<br>SRTEFTLTISILQSEDFAVYYCQQSFDDPFTFGQG<br>TKLEIK |
| SEQ ID NO: 3110 VL | E-H.18 | EIVLTQSPATLSVSPGERATLSCRASESVDSSGNS<br>FMHWYQQKPGQAPQLLIYRASNLESGIPARFSGSG<br>SRTEFTLTISSLQSEDFAVYYCQQSFDDPFTFGQG<br>TKLEIK |
| SEQ ID NO: 3111 VL | E-H.19 | AIRLTQSPFSLSASVGDRVTITCRASESVDSSGNS<br>FMHWYQQKPAKAPQLFTYRASNLESGVPSRFSGSG<br>SRTDFTLTISSLQPEDFATYYCQQSFDDPFTFGQG<br>TKLEIK |
| SEQ ID NO: 3112 VL | E-H.20 | DIQLTQSPSSLSASVGDRVTITCRASESVDSSGNS<br>FMHWYQQKPGKAPQSLIYRASNLESGVPSRFSGSG<br>SRTDFTLTISSLQPEDFATYYCQQSFDDPFTFGQG<br>TKLEIK |

TABLE 11-continued

| Amino acid sequences for anti TCRβ V5 antibodies | | |
|---|---|---|
| SEQ ID NO: 3113 VL | E-H.21 | DIQLTQSPSSLSASVGDRVTITCRASESVDSSGNSFMHWYQQKPGKAPQRLIYRASNLESGVPSRFSGSGSRTEFTLTISNLQPEDFATYYCQQSFDDPFTFGQGTKLEIK |
| SEQ ID NO: 3114 VL | E-H.22 | DIQLTQSPSTLSASVGDRVTITCRASESVDSSGNSFMHWYQQKPGKAPQLLIYRASNLESGVPSRFSGSGSRTEFTLTISSLQPDDFATYYCQQSFDDPFTFGQGTKLEIK |
| SEQ ID NO: 3115 VL | E-H.23 | EIVLTQSPDFQSVTPKEKVTITCRASESVDSSGNSFMHWYQQKPDQSPQLLIYRASNLESGVPSRFSGSGSRTDFTLTINSLEAEDAATYYCQQSFDDPFTFGQGTKLEIK |
| SEQ ID NO: 3116 VL | E-H.24 | DIQLTQSPSSLSASVGDRVTITCRASESVDSSGNSFMHWYQQKPGKAPQSLIYRASNLESGVPSKFSGSGSRTDFTLTISSLQPEDFATYYCQQSFDDPFTFGQGTKLEIK |
| SEQ ID NO: 3117 VL | E-H.25 | DIQLTQSPSSLSASVGDRVTITCRASESVDSSGNSFMHWYQQKPGKAPQRLIYRASNLESGVPSRFSGSGSRTEFTLTISSLQPEDFATYYCQQSFDDPFTFGQGTKLEIK |
| SEQ ID NO: 3118 VL | E-H.26 | DIVLTQTPLSLSVTPGQPASISCRASESVDSSGNSFMHWYLQKPGQPPQLLIYRASNLESGVPDRFSGSGSRTDFTLKISRVEAEDVGVYYCQQSFDDPFTFGQGTKLEIK |
| SEQ ID NO: 3119 VL | E-H.27 | DIQLTQSPSSLSASVGDRVTITCRASESVDSSGNSFMHWYQQKPEKAPQSLIYRASNLESGVPSRFSGSGSRTDFTLTISSLQPEDFATYYCQQSFDDPFTFGQGTKLEIK |
| SEQ ID NO: 3120 VL | E-H.28 | EIVLTQSPPTLSLSPGERVTLSCRASESVDSSGNSFMHWYQQKPGQAPQLLIYRASNLESGIPARFSGSGSRTDFTLTISSLQPEDFAVYYCQQSFDDPFTFGQGTKLEIK |
| SEQ ID NO: 3121 VL | E-H.29 | DIQLTQSPSAMSASVGDRVTITCRASESVDSSGNSFMHWYQQKPGKVPQRLIYRASNLESGVPSRFSGSGSRTEFTLTISSLQPEDFATYYCQQSFDDPFTFGQGTKLEIK |
| SEQ ID NO:3122 VL | E-H.30 | DIVLTQSPLSLPVTPGEPASISCRASESVDSSGNSFMHWYLQKPGQSPQLLIYRASNLESGVPDRFSGSGSRTDFTLKISRVEAEDVGVYYCQQSFDDPFTFGQGTKLEIK |
| SEQ ID NO: 3123 VL | E-H.31 | DIVLTQTPLSLPVTPGEPASISCRASESVDSSGNSFMHWYLQKPGQSPQLLIYRASNLESGVPDRFSGSGSRTDFTLKISRVEAEDVGVYYCQQSFDDPFTFGQGTKLEIK |
| SEQ ID NO: 3124 VL | E-H.32 | DIVLTQTPLSLSVTPGQPASISCRASESVDSSGNSFMHWYLQKPGQSPQLLIYRASNLESGVPDRFSGSGSRTDFTLKISRVEAEDVGVYYCQQSFDDPFTFGQGTKLEIK |
| SEQ ID NO: 3125 VL | E-H.33 | EIVLTQSPPTLSLSPGERVTLSCRASESVDSSGNSFMHWYQQKPGQAPQLLIYRASNLESSIPARFSGSGSRTDFTLTISSLQPEDFAVYYCQQSFDDPFTFGQGTKLEIK |
| SEQ ID NO: 3126 VL | E-H.34 | DIVLTQSPLSLPVTLGQPASISCRASESVDSSGNSFMHWYQQRPGQSPQRLIYRASNLESGVPDRFSGSGSRTDFTLKISRVEAEDVGVYYCQQSFDDPFTFGQGTKLEIK |
| SEQ ID NO: 3127 VL | E-H.35 | DIVLTQTPLSSPVTLGQPASISCRASESVDSSGNSFMHWYQQRPGQPPQLLIYRASNLESGVPDRFSGSGARTDFTLKISRVEAEDVGVYYCQQSFDDPFTFGQGTKLEIK |
| SEQ ID NO: 3128 VL | E-H.36 | DIVLTQSPAFLSVTPGEKVTITCRASESVDSSGNSFMHWYQQKPDQAPQLLIYRASNLESGVPSRFSGSGSRTDFTFTISSLEAEDAATYYCQQSFDDPFTFGQGTKLEIK |
| SEQ ID NO: 3129 VL | E-H.37 | DIQLIQSPSFLSASVGDRVSIICRASESVDSSGNSFMHWYLQKPGKSPQLFIYRASNLESGVSSRFSGRGSRTDFTLTIISLKPEDFAAYYCQQSFDDPFTFGQGTKLEIK |
| SEQ ID NO: 3130 VL | E-H.38 | EIVLTQTPLSLSITPGEQASISCRASESVDSSGNSFMHWYLQKARPVPQLLIYRASNLESGVPDRFSGSGSRTDFTLKISRVEAEDFGVYYCQQSFDDPFTFGQGTKLEIK |

TABLE 11-continued

| Amino acid sequences for anti TCRβ V5 antibodies | | |
|---|---|---|
| SEQ ID NO: 3131 | VL E-H.39 | EIVLTQTPLSLSITPGEQASMSCRASESVDSSGNSFMHWYLQKARPVPQLLIYRASNLESGVPDRFSGSGSRTDFTLKISRVEAEDFGVYYCQQSFDDPFTFGQGTKLEIK |
| SEQ ID NO: 3132 | VL E-H.40 | EITLTQSPAFMSATPGDKVNISCRASESVDSSGNSFMHWYQQKPGEAPQFITYRASNLESGIPPRFSGSGYRTDFTLTINNIESEDAAYYYCQQSFDDPFTFGQGTKLEIK |

Variable HEAVY chain (VH)

| | | |
|---|---|---|
| SEQ ID NO: 3133 | VH E-H.1 | QVQLVQSGAEVKKPGASVKVSCKASGYAFSSSWMNWVRQAPGQGLEWIGRIYPGDGDTKYNGKFKGRATLTADKSTSTAYMELSSLRSEDTAVYYCARRGTGGWYFDVWGQGTTVTVSS |
| SEQ ID NO: 3134 | VH E-H.2 | QVQLVQSGAEVKKPGSSVKVSCKASGYAFSSSWMNWVRQAPGQGLEWIGRIYPGDGDTKYNGKFKGRATLTADKSTSTAYMELSSLRSEDTAVYYCARRGTGGWYFDVWGQGTTVTVSS |
| SEQ ID NO: 3135 | VH E-H.3 | QVQLVQSGAEVKKPGASVKVSCKASGYAFSSSWMNWVRQAPGKGLEWIGRIYPGDGDTKYNGKFKGRATLTADKSTSTAYMELSSLRSEDTAVYYCARRGTGGWYFDVWGQGTTVTVSS |
| SEQ ID NO: 3136 | VH E-H.4 | QVQLVQSGAEVKKPGASVKVSCKASGYAFSSSWMNWVRQAPGQELEWIGRIYPGDGDTKYNGKFKGRATLTADKSISTAYMELSSLRSEDTATYYCARRGTGGWYFDVWGQGTTVTVSS |
| SEQ ID NO: 3137 | VH E-H.5 | EVQLVQSGAEVKKPGATVKISCKASGYAFSSSWMNWVQQAPGKGLEWIGRIYPGDGDTKYNGKFKGRATLTADKSTSTAYMELSSLRSEDTAVYYCARRGTGGWYFDVWGQGTTVTVSS |
| SEQ ID NO: 3138 | VH E-H.6 | QVQLVQSGAEVKKTGSSVKVSCKASGYAFSSSWMNWVRQAPGQALEWIGRIYPGDGDTKYNGKFKGRATLTADKSMSTAYMELSSLRSEDTAMYYCARRGTGGWYFDVWGQGTTVTVSS |
| SEQ ID NO: 3139 | VH E-H.7 | QVQLVQSGAEVKKPGASVKVSCKASGYAFSSSWMNWVRQAPGQRLEWIGRIYPGDGDTKYNGKFKGRATLTADKSASTAYMELSSLRSEDMAVYYCARRGTGGWYFDVWGQGTTVTVSS |
| SEQ ID NO: 3140 | VH E-H.8 | QVQLVQSGAEVKKPGASVKVSCKASGYAFSSSWMNWVRQAPGQGLEWIGRIYPGDGDTKYNGKFKGRATLTADKSTSTAYMELRSLRSDDMAVYYCARRGTGGWYFDVWGQGTTVTVSS |
| SEQ ID NO: 3141 | VH E-H.9 | QVQLVQSGAEVKKPGASVKVSCKASGYAFSSSWMNWVRQAPGQRLEWIGRIYPGDGDTKYNGKFKGRATLTADKSASTAYMELSSLRSEDTAVYYCARRGTGGWYFDVWGQGTTVTVSS |
| SEQ ID NO: 3142 | VH E-H.10 | QVQLVQSGAEVKKPGASVKVSCKASGYAFSSSWMNWVRQAPGQGLEWIGRIYPGDGDTKYNGKFKGRATLTADKSTSTAYMELRSLRSDDTAVYYCARRGTGGWYFDVWGQGTTVTVSS |
| SEQ ID NO: 3143 | VH E-H.11 | QVQLVQSGAEVKKPGASVKVSCKASGYAFSSSWMNWVRQAPGQGLEWIGRIYPGDGDTKYNGKFKGRATLTADKSISTAYMELSRLRSDDTAVYYCARRGTGGWYFDVWGQGTTVTVSS |
| SEQ ID NO: 3144 | VH E-H.12 | QVQLVQSGAEVKKPGASVKVSCKASGYAFSSSWMNWVROAPGQGLEWIGRIYPGDGDTKYNGKFKGRATLTADKSISTAYMELSRLRSDDTVVYYCARRGTGGWYFDVWGQGTTVTVSS |
| SEQ ID NO: 3145 | VH E-H.13 | QVQLVQSGAEVKKPGASVKVSCKASGYAFSSSWMNWVRQAPGQGLEWIGRIYPGDGDTKYNGKFKGWATLTADKSISTAYMELSRLRSDDTAVYYCARRGTGGWYFDVWGQGTTVTVSS |
| SEQ ID NO: 3146 | VH E-H.14 | QVQLVQSGAEVKKPGASVKVSCKASGYAFSSSWMNWVRQATGQGLEWIGRIYPGDGDTKYNGKFKGRATLTANKSISTAYMELSSLRSEDTAVYYCARRGTGGWY |
| SEQ ID NO: 3147 | VH E-H.15 | QVQLVQSGSELKKPGASVKVSCKASGYAFSSSWMNWVRQAPGQGLEWIGRIYPGDGDTKYNGKFKGRAVLSADKSVSTAYLQISSLKAEDTAVYYCARRGTGGWYFDVWGQGTTVTVSS |
| SEQ ID NO: 3148 | VH E-H.16 | QVQLVQSGPEVKKPGTSVKVSCKASGYAFSSSWMNWVRQARGQRLEWIGRIYPGDGDTKYNGKFKGRATLTADKSTSTAYMELSSLRSEDTAVYYCARRGTGGWYFDVWGQGTTVTVSS |

TABLE 11-continued

| Amino acid sequences for anti TCRβ V5 antibodies | | |
|---|---|---|
| SEQ ID NO: 3149 VH E-H.17 | EVQLVQSGAEVKKPGESLKISCKASGYAFSSSWMN WVRQMPGKGLEWIGRIYPGDGDTKYNGKFKGQATL SADKSISTAYLOWSSLKASDTAMYYCARRGTGGWY FDVWGQGTTVTVSS |
| SEQ ID NO: 3150 VH E-H.18 | QVQLVQSGSELKKPGASVKVSCKASGYAFSSSWMN WVRQAPGQGLEWIGRIYPGDGDTKYNGKFKGRAVL SADKSVSMAYLQISSLKAEDTAVYYCARRGTGGWY FDVWGQGTTVTVSS |
| SEQ ID NO: 3151 VH E-H.19 | QVQLVQSGHEVKQPGASVKVSCKASGYAFSSSWMN WVPQAPGQGLEWIGRIYPGDGDTKYNGKFKGRAVL SADKSASTAYLQISSLKAEDMAMYYCARRGTGGWY FDVWGQGTTVTVSS |
| SEQ ID NO: 3152 VH E-H.20 | EVQLVQSGAEVKKPGESLKISCKASGYAFSSSWMN WVRQMPGKGLEWIGRIYPGDGDTKYNGKFKGQATL SADKPISTAYLOWSSLKASDTAMYYCARRGTGGWY FDVWGQGTTVTVSS |
| SEQ ID NO: 3153 VH E-H.21 | EVOLVQSGAEVKKPGESLRISCKASGYAFSSSWMN WVRQMPGKGLEWIGRIYPGDGDTKYNGKFKGQATL SADKSISTAYLQWSSLKASDTAMYYCARRGTGGWY FDVWGQGTTVTVSS |
| SEQ ID NO: 3154 VH E-H.22 | EVQLVQSGAEVKKPGESLRISCKASGYAFSSSWMN WVRQMPGKGLEWIGRIYPGDGDTKYNGKFKGHATL SADKSISTAYLQWSSLKASDTAMYYCARRGTGGWY FDVWGQGTTVTVSS |
| SEQ ID NO: 3155 VH E-H.23 | QVQLVQSGAEVKKTGSSVKVSCKASGYAFSSSWMN WVRQAPRQALEWIGRIYPGDGDTKYNGKFKGRATL TADKSMSTAYMELSSLRSEDTAMYYCARRGTGGWY FDVWGQGTTVTVSS |
| SEQ ID NO: 3156 VH E-H.24 | EVOLVESGGGLVQPGRSLRLSCTASGYAFSSSWMN WVRQAPGKGLEWIGRIYPGDGDTKYNGKFKGRATL SADKSKSIAYLQMNSLKTEDTAVYYCARRGTGGWY FDVWGQGTTVTVSS |
| SEQ ID NO: 3157 VH E-H.25 | EVOLVESGGGLVQPGPSLRLSCTASGYAFSSSWMN WVRQAPGKGLEWIGRIYPGDGDTKYNGKFKGRATL SADKSKSIAYLQMNSLKTEDTAVYYCARRGTGGWY FDVWGQGTTVTVSS |
| SEQ ID NO: 3158 VH E-H.26 | QVQLQESGPGLVKPSQTLSLTCTASGYAFSSSWMN WVRQPPGKGLEWIGRIYPGDGDTKYNGKFKGRATL SADKSKSQASLKLSSVTAADTAVYYCARRGTGGWY FDVWGQGTTVTVSS |
| SEQ ID NO: 3159 VH E-H.27 | QVQLQESGPGLVKPSGTLSLTCAASGYAFSSSWMN WVRQPPGKGLEWIGRIYPGDGDTKYNGKFKGRATL SADKSKSQASLKLSSVTAADTAVYYCARRGTGGWY FDVWGQGTTVTVSS |
| SEQ ID NO: 3160 VH E-H.28 | EVOLVESGGGLVKPGRSLRLSCTASGYAFSSSWMN WVRQAPGKGLEWIGRIYPGDGDTKYNGKFKGRATL SADKSKSIAYLQMNSLKTEDTAVYYCARRGTGGWY FDVWGQGTTVTVSS |
| SEQ ID NO: 3161 VH E-H.29 | EVOLVESGGGLVQPGGSLKLSCAASGYAFSSSWMN WVRQASGKGLEWIGRIYPGDGDTKYNGKFKGRATL SADKSKSTAYLQMNSLKTEDTAVYYCARRGTGGWY FDVWGQGTTVTVSS |
| SEQ ID NO: 3162 VH E-H.30 | QVQLQESGPGLVKPSQTLSLTCAASGYAFSSSWMN WVRQPPGKGLEWIGRIYPGDGDTKYNGKFKGRATL SADKSKSQASLKLSSVTAADTAVYYCARRGTGGWY FDVWGQGTTVTVSS |
| SEQ ID NO: 3163 VH E-H.31 | EVOLVESGGGLVKPGGSLRLSCAASGYAFSSSWMN WVRQAPGKGLEWIGRIYPGDGDTKYNGKFKGRATL SADKSKSTAYLQMNSLKTEDTAVYYCARRGTGGWY FDVWGQGTTVTVSS |
| SEQ ID NO: 3164 VH E-H.32 | EVOLVESGGALVKPGGSLRLSCAASGYAFSSSWMN WVRQAPGKGLEWIGRIYPGDGDTKYNGKFKGRATL SADKSKSTAYLQMNSLKTEDTAVYYCARRGTGGWY FDVWGQGTTVTVSS |
| SEQ ID NO: 3165 VH E-H.33 | QVQLQESGPGLVKPSQTLSLTCAAYGYAFSSSWMN WVRQPPGKGLEWIGRIYPGDGDTKYNGKFKGRATL SADKSKSQASLKLSSVTAADTAVYYCARRGTGGWY FDVWGQGTTVTVSS |
| SEQ ID NO: 3166 VH E-H.34 | QVQLQESGSGLVKPSQTLSLTCAASGYAFSSSWMN WVRQPPGKGLEWIGRIYPGDGDTKYNGKFKGRATL SADKSKSQASLKLSSVTAADTAVYYCARRGTGGWY FDVWGQGTTVTVSS |

TABLE 11-continued

Amino acid sequences for anti TCRβ V5 antibodies

| | | |
|---|---|---|
| SEQ ID NO: 3167 | VH E-H.35 | EVOLVESGGGLVQPGGSLRLSCAASGYAFSSSWMN<br>WVRQAPGKGLEWIGRIYPGDGDTKYNGKFKGRATL<br>SADKSKSSAYLQMNSLKTEDTAVYYCARRGTGGWY<br>FDVWGQGTTVTVSS |
| SEQ ID NO: 3168 | VH E-H.36 | QVQLQESGPGLVKPSDTLSLTCTASGYAFSSSWMN<br>WVRQPPGKGLEWIGRIYPGDGDTKYNGKFKGRATL<br>SADKSKSQASLKLSSVTAADTAVYYCARRGTGGWY<br>FDVWGQGTTVTVSS |
| SEQ ID NO: 3169 | VH E-H.37 | QVQLQESGPGLVKPSQTLSLTCTASGYAFSSSWMN<br>WVRQHPGKGLEWIGRIYPGDGDTKYNGKFKGRATL<br>SADKSKSQASLKLSSVTAADTAVYYCARRGTGGWY<br>FDVWGQGTTVTVSS |
| SEQ ID NO: 3170 | VH E-H.38 | QVQLQESGPGLVKPSQTLSLTCTASGYAFSSSWMN<br>WVRQHPGKGLEWIGRIYPGDGDTKYNGKFKGLATL<br>SADKSKSQASLKLSSVTAADTAVYYCARRGTGGWY<br>FDVWGQGTTVTVSS |
| SEQ ID NO: 3171 | VH E-H.39 | QVQLVESGGGVVQPGRSLRLSCAASGYAFSSSWMN<br>WVRQAPGKGLEWIGRIYPGDGDTKYNGKFKGRATL<br>SADKSKSTAYLQMSSLRAEDTAVYYCARRGTGGWY<br>FDVWGQGTTVTVSS |
| SEQ ID NO: 3172 | VH E-H.40 | QVQLVESGGGLVKPGGSLRLSCAASGYAFSSSWMN<br>WVRQAPGKGLEWIGRIYPGDGDTKYNGKFKGRATL<br>SADKAKSSAYLQMNSLRAEDTAVYYCARRGTGGWY<br>FDVWGQGTTVTVSS |
| SEQ ID NO: 3173 | VH E-H.41 | QVQLVESGGGLVQPGGSLRLSCSASGYAFSSSWMN<br>WVRQAPGKGLEWIGRIYPGDGDTKYNGKFKGRATL<br>SADKSKSTAYLQMNSLRAEDTAVYYCARRGTGGWY<br>FDVWGQGTTVTVSS |
| SEQ ID NO: 3174 | VH E-H.42 | QVQLLESGGGLVKPGGSLRLSCAASGYAFSSSWMN<br>WVRQAPGKGLEWIGRIYPGDGDTKYNGKFKGRATL<br>SADKAKSSAYLQMNSLRAEDTAVYYCARRGTGGWY<br>FDVWGQGTTVTVSS |
| SEQ ID NO: 3175 | VH E-H.43 | EVOLVESGGGLVQPGGSLRLSCSASGYAFSSSWMN<br>WVRQAPGKGLEWIGRIYPGDGDTKYNGKFKGRATL<br>SADKSKSTAYLQMSSLRAEDTAVYYCARRGTGGWY<br>FDVWGQGTTVTVSS |
| SEQ ID NO: 3176 | VH E-H.44 | QVQLQESGPGLVKPSDTLSLTCAASGYAFSSSWMN<br>WVRQPPGKGLEWIGRIYPGDGDTKYNGKFKGRATL<br>SADKSKSQASLKLSSVTAVDTAVYYCARRGTGGWY<br>FDVWGQGTTVTVSS |
| SEQ ID NO: 3177 | VH E-H.45 | QVQLQESGPGLVKPSQTLSLTCAASGYAFSSSWMN<br>WVRQPPGKGLEWIGRIYPGDGDTKYNGKFKGRATL<br>SADKSKSQASLKLSSVTAVDTAVYYCARRGTGGWY<br>FDVWGQGTTVTVSS |
| SEQ ID NO: 3178 | VH E-H.46 | EVOLVESGGGLVQPGGSLRLSCSASGYAFSSSWMN<br>WVRQAPGKGLEWIGRIYPGDGDTKYNGKFKGRATL<br>SADKSKSTAYVQMSSLRAEDTAVYYCARRGTGGWY<br>FDVWGQGTTVTVSS |
| SEQ ID NO: 3179 | VH E-H.47 | QVQLVDSGGGVVQPGRSLRLSCAASGYAFSSSWMN<br>WVRQAPGKGLEWIGRIYPGDGDTKYNGKFKGRATL<br>SADKSKSTAYLQMNSLRAEDTAVYYCARRGTGGWY<br>FDVWGQGTTVTVSS |
| SEQ ID NO: 3180 | VH E-H.48 | QVQLVESGGGVVQPGRSLRLSCAASGYAFSSSWMN<br>WVRQAPGKGLEWIGRIYPGDGDTKYNGKFKGRATL<br>SADKSKSTAYLQMNSLRAEGTAVYYCARRGTGGWY<br>FDVWGQGTTVTVSS |
| SEQ ID NO: 3181 | VH E-H.49 | QVQLVESGGGVVQPGRSLRLSCAASGYAFSSSWMN<br>WVRQAPGKGLEWIGRIYPGDGDTKYNGKFKGRATL<br>SADKSKSTAYLQMNSLRAEDTAVYYCARRGTGGWY<br>FDVWGQGTTVTVSS |
| SEQ ID NO: 3182 | VH E-H.50 | EVOLVESGGGLVQPGGSLRLSCAASGYAFSSSWMN<br>WVRQAPGKGLEWIGRIYPGDGDTKYNGKFKGRATL<br>SADKSKSTAYLQMNSLRAEDTAVYYCARRGTGGWY<br>FDVWGQGTTVTVSS |

In some embodiments, the anti-TCRβ V5 antibody molecule comprises a VH and/or a VL of an antibody described in Table 10, or a sequence with at least 80%, 85%, 90%, 95%, 96%, 97%, 98%, 99% or more identity thereto.

In some embodiments, the anti-TCRβ V5 antibody molecule comprises a VH and a VL of an antibody described in Table 10, or a sequence with at least 80%, 85%, 90%, 95%, 96%, 97%, 98%, 99% or more identity thereto.

In some embodiments, the anti-TCRβ V5 antibody molecule comprises a VH and/or a VL of an antibody described in Table 11, or a sequence with at least 80%, 85%, 90%, 95%, 96%, 97%, 98%, 99% or more identity thereto.

In some embodiments, the anti-TCRβ V5 antibody molecule comprises a VH and a VL of an antibody described in Table 11, or a sequence with at least 80%, 85%, 90%, 95%, 96%, 97%, 98%, 99% or more identity thereto.

Anti-TCRβ V10 Antibodies

Accordingly, in one aspect, the disclosure provides an anti-TCRβV antibody molecule that binds to a human TCRβ V10 subfamily member. In some embodiments, TCRβ V10 subfamily is also known as TCRβ V12. In some embodiments, the TCRβ V10 subfamily comprises: TCRβ V10-1*01, TCRβ V10-1*02, TCRβ V10-3*01 or TCRβ V10-2*01, or a variant thereof.

TABLE 12

Amino acid sequences for anti TCRβ V10 antibodies

Murine antibody D

| | |
|---|---|
| SEQ ID NO: 3183 VH | EVQLVESGGDLVKPGGSLKLSCAVSGFTFRSYGMSWVR QTPDKRLEWVALISSGGSYTYYTDSVKGRFTISRDNAKN TLYLQMSSLKSEDTAIYYCSRHGGNFFDYWGQGTTLTVS S |
| SEQ ID NO: 3184 VL | QIVLTQSPSIMSASPGEKVTMTCSVSSSVSYMHWYQQKS GTSPKRWIYDTSKLASGVPARFSGSGSGTSYSLTISSMEA EDAATYYCQQWSSNPQYTFGGGTKLEIK |

Humanized antibody D (D-H antibody)
Variable light chain (VL)

| | | |
|---|---|---|
| SEQ ID NO: 3185 | VL  D-H.1 | DIVLTQSPAFLSVTPGEKVTITCSVSSSVSYMHWY QQKPDQAPKLLIYDTSKLASGVPSRFSGSGSGTDY TFTISSLEAEDAATYYCQQWSSNPQYTFGQGTKLE IK |
| SEQ ID NO: 3186 | VL  D-H.2 | AIQLTQSPSSLSASVGDRVTITCSVSSSVSYMHWY QQKPGKAPKLLIYDTSKLASGVPSRFSGSGSGTDY TLTISSLQPEDFATYYCQQWSSNPQYTFGQGTKLE IK |
| SEQ ID NO: 3187 | VL  D-H.3 | DIQLTQSPSFLSASVGDRVTITCSVSSSVSYMHWY QQKPGKAPKLLIYDTSKLASGVPSRFSGSGSGTEY TLTISSLQPEDFATYYCQQWSSNPQYTFGQGTKLE IK |
| SEQ ID NO: 3188 | VL  D-H.4 | DIQLTQSPSSLSASVGDRVTITCSVSSSVSYMHWY QQKPGKAPKLLIYDTSKLASGVPSRFSGSGSGTDY TLTISSLQPEDFATYYCQQWSSNPQYTFGQGTKLE IK |
| SEQ ID NO: 3189 | VL  D-H.5 | DIQLTQSPSSVSASVGDRVTITCSVSSSVSYMHWY QQKPGKAPKLLIYDTSKLASGVPSRFSGSGSGTDY TLTISSLQPEDFATYYCQQWSSNPQYTFGQGTKLE IK |
| SEQ ID NO: 3190 | VL  D-H.6 | DIQLTQSPSSLSASVGDRVTITCSVSSSVSYMHWY QQKPGKVPKLLIYDTSKLASGVPSRFSGSGSGTDY TLTISSLQPEDVATYYCQQWSSNPQYTFGQGTKLE IK |
| SEQ ID NO: 3191 | VL  D-H.7 | DIQLTQSPSSLSASVGDRVTITCSVSSSVSYMHWY QQKPGQAPKLLIYDTSKLASGVPSRFSGSGSGTDY TLTISSLOPEDVATYYCQQWSSNPQYTFGQGTKLE IK |
| SEQ ID NO: 3192 | VL  D-H.8 | EIVLTQSPDFQSVTPKEKVTITCSVSSSVSYMHWY QQKPDQSPKLLIYDTSKLASGVPSRFSGSGSGTDY TLTINSLEAEDAATYYCQQWSSNPQYTFGQGTKLE IK |
| SEQ ID NO: 3193 | VL  D-H.9 | AIRLTQSPFSLSASVGDRVTITCSVSSSVSYMHWY QQKPAKAPKLFIYDTSKLASGVPSRFSGSGSGTDY TLTISSLQPEDFATYYCQQWSSNPQYTFGQGTKLE IK |
| SEQ ID NO: 3194 | VL  D-H.10 | DIQLTQSPSSLSASVGDRVTITCSVSSSVSYMHWY QQKPGKAPKLLIYDTSKLASGVPSRFSGSGSGTDY TFTISSLQPEDIATYYCQQWSSNPQYTFGQGTKLE IK |
| SEQ ID NO: 3195 | VL  D-H.11 | EIVLTQSPATLSLSPGERATLSCSVSSSVSYMHWY QQKPGQAPKLLIYDTSKLASGIPARFSGSGSGTDY TLTISSLEPEDFAVYYCQQWSSNPQYTFGQGTKLE IK |
| SEQ ID NO: 3196 | VL  D-H.12 | DIQLTQSPSTLSASVGDRVTITCSVSSSVSYMHWY QQKPGKAPKLLIYDTSKLASGVPSRFSGSGSGTEY TLTISSLQPDDFATYYCQQWSSNPQYTFGQGTKLE IK |
| SEQ ID NO: 3197 | VL  D-H.13 | DIQLTQSPSSLSASVGDRVTITCSVSSSVSYMHWY QQKPGKTPKLLIYDTSKLASGIPSRFSGSGSGTDY TLTIRSLQPEDFATYYCQQWSSNPQYTFGQGTKLE IK |
| SEQ ID NO: 3198 | VL  D-H.14 | EIVLTQSPPTLSLSPGERVTLSCSVSSSVSYMHWY QQKPGQAPKLLIYDTSKLASGIPARFSGSGSGTDY TLTISSLQPEDFAVYYCQQWSSNPQYTFGQGTKLE IK |
| SEQ ID NO: 3199 | VL  D-H.15 | DIQLTQSPSSLSASVGDRVTITCSVSSSVSYMHWY QQKPGKAPKRLIYDTSKLASGVPSRFSGSGSGTEY TLTISSLQPEDFATYYCQQWSSNPQYTFGQGTKLE IK |

TABLE 12-continued

| Amino acid sequences for anti TCRβ V10 antibodies | | |
|---|---|---|
| SEQ ID NO: 3200 VL | D-H.16 | EIVLTQSPATLSLSPGERATLSCSVSSSVSYMHWYQQKPGQAPKLLIYDTSKLASGIPARFSGSGPGTDYTLTISSLEPEDFAVYYCQQWSSNPQYTFGQGTKLEIK |
| SEQ ID NO: 3201 VL | D-H.17 | EIVLTQSPATLSLSPGERATLSCSVSSSVSYMHWYQQKPGQAPKLLIYDTSKLASGIPARFSGSGSGTDYTLTISRLEPEDFAVYYCQQWSSNPQYTFGQGTKLEIK |
| SEQ ID NO: 3202 VL | D-H.18 | EIVLTQSPATLSLSPGERATLSCSVSSSVSYMHWYQQKPGQAPKLLIYDTSKLASGIPARFSGSGSGTDYTLTISSLQPEDFAVYYCQQWSSNPQYTFGQGTKLEIK |
| SEQ ID NO: 3203 VL | D-H.19 | EIVLTQSPATLSVSPGERATLSCSVSSSVSYMHWYQQKPGQAPKLLIYDTSKLASGIPARFSGSGSGTEYTLTISSLQSEDFAVYYCQQWSSNPQYTFGQGTKLEIK |
| SEQ ID NO: 3204 VL | D-H.20 | EIVLTQSPATLSVSPGERATLSCSVSSSVSYMHWYQQKPGQAPKLLIYDTSKLASGIPARFSGSGSGTEYTLTISILQSEDFAVYYCQQWSSNPQYTFGQGTKLEIK |
| SEQ ID NO: 3205 VL | D-H.21 | EIVLTQSPPTLSLSPGERVTLSCSVSSSVSYMHWYQQKPGQAPKLLIYDTSKLASSIPARFSGSGSGTDYTLTISSLQPEDFAVYYCQQWSSNPQYTFGQGTKLEIK |
| SEQ ID NO: 3206 VL | D-H.22 | DIQLTQSPSSLSASVGDRVTITCSVSSSVSYMHWYQQKPGKAPKSLIYDTSKLASGVPSRFSGSGSGTDYTLTISSLQPEDFATYYCQQWSSNPQYTFGQGTKLEIK |
| SEQ ID NO: 3207 VL | D-H.23 | DIQLTQSPSSLSASVGDRVTITCSVSSSVSYMHWYQQKPGKAPKRLIYDTSKLASGVPSRFSGSGSGTEYTLTISNLQPEDFATYYCQQWSSNPQYTFGQGTKLEIK |
| SEQ ID NO: 3208 VL | D-H.24 | DIQLTQSPSAMSASVGDRVTITCSVSSSVSYMHWYQQKPGKVPKRLIYDTSKLASGVPSRFSGSGSGTEYTLTISSLQPEDFATYYCQQWSSNPQYTFGQGTKLEIK |
| SEQ ID NO: 3209 VL | D-H.25 | EIVLTQSPATLSLSPGERATLSCSVSSSVSYMHWYQQKPGQAPKLLIYDTSKLASGIPDRFSGSGSGTDYTLTISRLEPEDFAVYYCQQWSSNPQYTFGQGTKLEIK |
| SEQ ID NO: 3210 VL | D-H.26 | EIVLTQSPATLSLSPGERATLSCSVSSSVSYMHWYQQKPGLAPKLLIYDTSKLASGIPDRFSGSGSGTDYTLTISRLEPEDFAVYYCQQWSSNPQYTFGQGTKLEIK |
| SEQ ID NO: 3211 VL | D-H.27 | EIVLTQSPGTLSLSPGERATLSCSVSSSVSYMHWYQQKPGQAPKLLIYDTSKLASGIPDRFSGSGSGTDYTLTISRLEPEDFAVYYCQQWSSNPQYTFGQGTKLEIK |
| SEQ ID NO: 3212 VL | D-H.28 | DIQLTQSPSSLSASVGDRVTITCSVSSSVSYMHWYQQKPGKAPKSLIYDTSKLASGVPSKFSGSGSGTDYTLTISSLQPEDFATYYCQQWSSNPQYTFGQGTKLEIK |
| SEQ ID NO: 3213 VL | D-H.29 | DIQLTQSPSSLSASVGDRVTITCSVSSSVSYMHWYQQKPEKAPKSLIYDTSKLASGVPSRFSGSGSGTDYTLTISSLQPEDFATYYCQQWSSNPQYTFGQGTKLEIK |
| SEQ ID NO: 3214 VL | D-H.30 | DIVLTQSPDSLAVSLGERATINCSVSSSVSYMHWYQQKPGQPPKLLIYDTSKLASGVPDRFSGSGSGTDYTLTISSLQAEDVAVYYCQQWSSNPQYTFGQGTKLEIK |
| SEQ ID NO: 3215 VL | D-H.31 | EIVLTQTPLSLSITPGEQASMSCSVSSSVSYMHWYLQKARPVPKLLIYDTSKLASGVPDRFSGSGSGTDYTLKISRVEAEDFGVYYCQQWSSNPQYTFGQGTKLEIK |
| SEQ ID NO: 3216 VL | D-H.32 | EIVLTQTPLSLSITPGEQASISCSVSSSVSYMHWYLQKARPVPKLLIYDTSKLASGVPDRFSGSGSGTDYTLKISRVEAEDFGVYYCQQWSSNPQYTFGQGTKLEIK |
| SEQ ID NO: 3217 VL | D-H.33 | DIVLTQSPLSLPVTPGEPASISCSVSSSVSYMHWYLQKPGQSPKLLIYDTSKLASGVPDRFSGSGSGTDYTLKISRVEAEDVGVYYCQQWSSNPQYTFGQGTKLEIK |

TABLE 12-continued

| Amino acid sequences for anti TCRβ V10 antibodies | | |
|---|---|---|
| SEQ ID NO: 3218 VL D-H.34 | DIVLTQSPLSLPVTLGQPASISCSVSSSVSYMHWYQQRPGQSPKRLIYDTSKLASGVPDRFSGSGSGTDYTLKISRVEAEDVGVYYCQQWSSNPQYTFGQGTKLEIK | |
| SEQ ID NO: 3219 VL D-H.35 | DIVLTQTPLSLPVTPGEPASISCSVSSSVSYMHWYLQKPGQSPKLLIYDTSKLASGVPDRFSGSGSGTDYTLKISRVEAEDVGVYYCQQWSSNPQYTFGQGTKLEIK | |
| SEQ ID NO: 3220 VL D-H.36 | DIVLTQTPLSLSVTPGQPASISCSVSSSVSYMHWYLQKPGQSPKLLIYDTSKLASGVPDRFSGSGSGTDYTLKISRVEAEDVGVYYCQQWSSNPQYTFGQGTKLEIK | |
| SEQ ID NO: 3221 VL D-H.37 | DIVLTQTPLSLSVTPGQPASISCSVSSSVSYMHWYLQKPGQPPKLLIYDTSKLASGVPDRFSGSGSGTDYTLKISRVEAEDVGVYYCQQWSSNPQYTFGQGTKLEIK | |
| SEQ ID NO: 3222 VL D-H.38 | DIQLIQSPSFLSASVGDRVSIICSVSSSVSYMHWYLQKPGKSPKLFIYDTSKLASGVSSRFSGRGSGTDYTLTIISLKPEDFAAYYCQQWSSNPQYTFGQGTKLEIK | |
| SEQ ID NO: 3223 VL D-H.39 | DIVLTQTPLSSPVTLGQPASISCSVSSSVSYMHWYQQRPGQPPKLLIYDTSKLASGVPDRFSGSGAGTDYTLKISRVEAEDVGVYYCQQWSSNPQYTFGQGTKLEIK | |
| SEQ ID NO: 3224 VL D-H.40 | EITLTQSPAFMSATPGDKVNISCSVSSSVSYMHWYQQKPGEAPKFITYDTSKLASGIPPRFSGSGYGTDYTLTINNIESEDAAYYYCQQWSSNPQYTFGQGTKLEIK | |
| | Variable HEAVY chain (VH) | |
| SEQ ID NO: 3225 VH D-H.1 | EVQLVESGGGLVKPGGSLRLSCAVSGFTFRSYGMSWVRQAPGKGLEWVALISSGGSYTYYTDSVKGRFTISRDNSKNTLYLQMNSLKTEDTAVYYCSRHGGNFFDYWGQGTTVTVSS | |
| SEQ ID NO: 3226 VH D-H.2 | EVQLVESGGALVKPGGSLRLSCAVSGFTFRSYGMSWVRQAPGKGLEWVALISSGGSYTYYTDSVKGRFTISRDNSKNTLYLQMNSLKTEDTAVYYCSRHGGNFFDYWGQGTTVTVSS | |
| SEQ ID NO: 3227 VH D-H.3 | EVQLVESGGGLVQPGGSLRLSCAVSGFTFRSYGMSWVRQAPGKGLEWVALISSGGSYTYYTDSVKGRFTISRDNAKNTLYLQMNSLRAEDTAVYYCSRHGGNFFDYWGQGTTVTVSS | |
| SEQ ID NO: 3228 VH D-H.4 | EVQLVESGGGLVQPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS | |
| SEQ ID NO: 3229 VH D-H.5 | EVQLVESGGGLVQPGGSLRLSCAVSGFTFRSYGMSWVRQAPGKGLEWVALISSGGSYTYYTDSVKGRFTISRDNSKNSLYLQMNSLKTEDTAVYYCSRHGGNFFDYWGQGTTVTVSS | |
| SEQ ID NO: 3230 VH D-H.6 | EVQLVESGGGLVQPGGSLRLSCAVSGFTFRSYGMSWVRQAPGKGLEWVALISSGGSYTYYTDSVKGRFTISRDNAKNSLYLQMNSLRAEDMAVYYCSRHGGNFFDYWGQGTTVTVSS | |
| SEQ ID NO: 3231 VH D-H.7 | EVQLVESGGGLVQPGGSLRLSCAVSGFTFRSYGMSWVRQAPGKGLEWVALISSGGSYTYYTDSVKGQFTISRDNAKNTLYLQMNSLRAEDMAVYYCSRHGGNFFDYWGQGTTVTVSS | |
| SEQ ID NO: 3232 VH D-H.8 | EVQLVESGGGLVKPGRSLRLSCTVSGFTFRSYGMSWVRQAPGKGLEWVALISSGGSYTYYTDSVKGRFTISRDNSKNILYLQMNSLKTEDTAVYYCSRHGGNFFDYWGQGTTVTVSS | |
| SEQ ID NO: 3233 VH D-H.9 | EVQLVESGGGLVKPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS | |
| SEQ ID NO: 3234 VH D-H.10 | EVQLVESGGGLVQPGGSLKLSCAVSGFTFRSYGMSWVRQASGKGLEWVALISSGGSYTYYTDSVKGRFTISRDNSKNTLYLQMNSLKTEDTAVYYCSRHGGNFFDYWGQGTTVTVSS | |
| SEQ ID NO: 3235 VH D-H.11 | QVQLVESGGGVVQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS | |
| SEQ ID NO: 3236 VH D-H.12 | QVQLVESGGGVVQPGRSLRLSCAVSGFTFRSYGMSWVRQAPGKGLEWVALISSGGSYTYYTDSVKGRFTISRDNSKNTLYLQMSSLRAEDTAVYYCSRHGGNFFDYWGQGTTVTVSS | |

TABLE 12-continued

| Amino acid sequences for anti TCRβ V10 antibodies | | |
|---|---|---|
| SEQ ID NO: 3237 VH D-H.13 | EVQLVESGGGLVQPGGSLRLSCPVSGFTFRSYGMSWVRQAPGKGLEWVALISSGGSYTYYTDSVKGRFTISRDNANNSLYLQMNSLRAEDTAVYYCSRHGGNFFDYWGQGTTVTVSS |
| SEQ ID NO: 3238 VH D-H.14 | EVQLVESGGGLVQPGRSLRLSCTVSGFTFRSYGMSWVRQAPGKGLEWVALISSGGSYTYYTDSVKGRFTISRDNSKNILYLQMNSLKTEDTAVYYCSRHGGNFFDYWGQGTTVTVSS |
| SEQ ID NO: 3239 VH D-H.15 | EVQLVESGGGLVQPGPSLRLSCTVSGFTFRSYGMSWVRQAPGKGLEWVALISSGGSYTYYTDSVKGRFTISRDNSKNILYLQMNSLKTEDTAVYYCSRHGGNFFDYWGQGTTVTVSS |
| SEQ ID NO: 3240 VH D-H.16 | EVQLVESGGGLVQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS |
| SEQ ID NO: 3241 VH D-H.17 | EVQLVESGGGLVQPGGSLRLSCAVSGFTFRSYGMSWVRQAPGKGLEWVALISSGGSYTYYTDSVKGRFTISRDNAKNSLYLQMNSLRDEDTAVYYCSRHGGNFFDYWGQGTTVTVSS |
| SEQ ID NO: 3242 VH D-H.18 | QVQLVESGGGLVKPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS |
| SEQ ID NO: 3243 VH D-H.19 | QVQLVESGGGVVQPGRSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS |
| SEQ ID NO: 3244 VH D-H.20 | EVQLLESGGGLVQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS |
| SEQ ID NO: 3245 VH D-H.21 | EVQLVESGGGLVQPGGSLRLSCAVSGFTFRSYGMSWVRQAPGKGLEWVALISSGGSYTYYTDSVKGRFTISRHNSKNTLYLQMNSLRAEDTAVYYCSRHGGNFFDYWGQGTTVTVSS |
| SEQ ID NO: 3246 VH D-H.22 | EVQLVESGGGLIQPGGSLRLSCAVSGFTFRSYGMSWVRQPPGKGLEWVALISSGGSYTYYTDSVKGRFTISRDNSKNTLYLQMNSLRAEDTAVYYCSRHGGNFFDYWGQGTTVTVSS |
| SEQ ID NO: 3247 VH D-H.23 | EVQLVESGGGLIQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS |
| SEQ ID NO: 3248 VH D-H.24 | EVQLVESGGGLVQPGRSLRLSCAVSGFTFRSYGMSWVRQAPGKGLEWVALISSGGSYTYYTDSVKGRFTISRDNAKNSLYLQMNSLRAEDTALYYCSRHGGNFFDYWGQGTTVTVSS |
| SEQ ID NO: 3249 VH D-H.25 | QVQLVESGGGVVQPGRSLRLSCAVSGFTFRSYGMSWVRQAPGKGLEWVALISSGGSYTYYTDSVKGRFTISRDNSKNRLYLQMNSLRAEDTAVYYCSRHGGNFFDYWGQGTTVTVSS |
| SEQ ID NO: 3250 VH D-H.26 | QVQLVESGGGVVQPGRSLRLSCAVSGFTFRSYGMSWVRQAPGKGLEWVALISSGGSYTYYTDSVKGRFTISRDNSKNTLYLQMNSLRAEGTAVYYCSRHGGNFFDYWGQGTTVTVSS |
| SEQ ID NO: 3251 VH D-H.27 | QVQLVESGGGVVQPGRSLRLSCAVSGFTFRSYGMSWVRQAPGKGLEWVALISSGGSYTYYTDSVKGRFAISRDNSKNTLYLQMNSLRAEDTAVYYCSRHGGNFFDYWGQGTTVTVSS |
| SEQ ID NO: 3252 VH D-H.28 | QVQLVDSGGGVVQPGRSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS |
| SEQ ID NO: 3253 VH D-H.29 | EVQLVESGGGVVRPGGSLRLSCAVSGFTFRSYGMSWVRQAPGKGLEWVALISSGGSYTYYTDSVKGRFTISRDNAKNSLYLQMNSLRAEDTALYHCSRHGGNFFDYWGQGTTVTVSS |
| SEQ ID NO: 3254 VH D-H.30 | EVQLVESGGGVVVQPGGSLRLSCAVSGFTFRSYGMSWVRQAPGKGLEWVALISSGGSYTYYTDSVKGRFTISRDNSKNSLYLQMNSLRAEDTALYYCSRHGGNFFDYWGQGTTVTVSS |
| SEQ ID NO: 3255 VH D-H.31 | EVQLVESGGGVVVQPGGSLRLSCAVSGFTFRSYGMSWVRQAPGKGLEWVALISSGGSYTYYTDSVKGRFTISRDNSKNSLYLQMNSLRTEDTALYYCSRHGGNFFDYWGQGTTVTVSS |
| SEQ ID NO: 3256 VH D-H.32 | EVQLVESGGVVVQPGGSLRLSCAVSGFTFRSYGMSWVRQAPGKGLEWVALISSGGSYTYYTDSVKGRFTI |

TABLE 12-continued

Amino acid sequences for anti TCRβ V10 antibodies

| | | |
|---|---|---|
| | | SRDNSKNSLYLQMNSLRTEDTALYYCSRHGGNFFD<br>YWGQGTTVTVSS |
| SEQ ID NO: 3257 VH | D-H.33 | EVQLVETGGGLIQPGGSLRLSCAVSGFTFRSYGMS<br>WVRQAPGKGLEWVALISSGGSYTYYTDSVKGRFTI<br>SRDNSKNTLYLQMNSLRAEDTAVYYCSRHGGNFFD<br>YWGQGTTVTVSS |
| SEQ ID NO: 3258 VH | D-H.34 | EVQLVESGGGLVQPGGSLRLSCAVSGFTFRSYGMS<br>WVRQATGKGLEWVALISSGGSYTYYTDSVKGRFTI<br>SRENAKNSLYLQMNSLRAGDTAVYYCSRHGGNFFD<br>YWGQGTTVTVSS |
| SEQ ID NO: 3259 VH | D-H.35 | EVQLVESRGVLVQPGGSLRLSCAVSGFTFRSYGMS<br>WVRQAPGKGLEWVALISSGGSYTYYTDSVKGRFTI<br>SRDNSKNTLHLQMNSLRAEDTAVYYCSRHGGNFFD<br>YWGQGTTVTVSS |
| SEQ ID NO: 3260 VH | D-H.36 | EVQLVESGGGLVQPGRSLRLSCAVSGFTFRSYGMS<br>WVRQAPGKGLEWVALISSGGSYTYYTDSVKGRFTI<br>SRDNAKNSLYLQMNSLRAEDMALYYCSRHGGNFFD<br>YWGQGTTVTVSS |
| SEQ ID NO: 3261 VH | D-H.37 | QVQLVESGGGLVQPGGSLRLSCSVSGFTFRSYGMS<br>WVRQAPGKGLEWVALISSGGSYTYYTDSVKGRFTI<br>SRDNSKNTLYLQMNSLRAEDTAVYYCSRHGGNFFD<br>YWGQGTTVTVSS |
| SEQ ID NO: 3262 VH | D-H.38 | EVQLVESGGGLVQPGGSLRLSCSVSGFTFRSYGMS<br>WVRQAPGKGLEWVALISSGGSYTYYTDSVKGRFTI<br>SRDNSKNTLYLQMSSLRAEDTAVYYCSRHGGNFFD<br>YWGQGTTVTVSS |
| SEQ ID NO: 3263 VH | D-H.39 | QVQLVESGGGVVQPGRSLRLSCAVSGFTFRSYGMS<br>WVRQAPGKGLEWVALISSGGSYTYYTDSVKGRFTI<br>SRDNSTNTLFLQMNSLRAEDTAVYYCSRHGGNFFD<br>YWGQGTTVTVSS |
| SEQ ID NO: 3264 VH | D-H.40 | QVQLLESGGGLVKPGGSLRLSCAVSGFTFRSYGMS<br>WVRQAPGKGLEWVALISSGGSYTYYTDSVKGRFTI<br>SRDNAKNSLYLQMNSLRAEDTAVYYCSRHGGNFFD<br>YWGQGTTVTVSS |
| SEQ ID NO: 3265 VH | D-H.41 | EVQLVESGEGLVQPGGSLRLSCAVSGFTFRSYGMS<br>WVRQAPGKGLEWVALISSGGSYTYYTDSVKGRFTI<br>SRDNSKNTLYLQMGSLRAEDMAVYYCSRHGGNFFD<br>YWGQGTTVTVSS |
| SEQ ID NO: 3266 VH | D-H.42 | EVQLVESGGGLVQPGGSLRLSCAVSGFTFRSYGMS<br>WVRQAPGKGLEWVALISSGGSYTYYTDSVKGRFTI<br>SRDNSKNTLYLQMGSLRAEDMAVYYCSRHGGNFFD<br>YWGQGTTVTVSS |
| SEQ ID NO: 3267 VH | D-H.43 | EVQLVESGGGLVQPGGSLRLSCSVSGFTFRSYGMS<br>WVRQAPGKGLEWVALISSGGSYTYYTDSVKGRFTI<br>SRDNSKNTLYVQMSSLRAEDTAVYYCSRHGGNFFD<br>YWGQGTTVTVSS |
| SEQ ID NO: 3268 VH | D-H.44 | EVQLVESGGGLVQPGGSLRLSCAVSGFTFRSYGMS<br>WVRQAPGKGLEWVALISSGGSYTYYTDSVKGRFII<br>SRDNSRNSLYLQKNRRRAEDMAVYYCSRHGGNFFD<br>YWGQGTTVTVSS |
| SEQ ID NO: 3269 VH | D-H.45 | EVQLVESGGGLVQPGGSLRLSCAVSGFTFRSYGMS<br>WVHQAPGKGLEWVALISSGGSYTYYTDSVKGRFII<br>SRDNSRNTLYLQTNSLRAEDTAVYYCSRHGGNFFD<br>YWGQGTTVTVSS |
| SEQ ID NO: 3270 VH | D-H.46 | EVHLVESGGGLVQPGGALRLSCAVSGFTFRSYGMS<br>WVRQATGKGLEWVALISSGGSYTYYTDSVKGRFTI<br>SRENAKNSLYLQMNSLRAGDTAVYYCSRHGGNFFD<br>YWGQGTTVTVSS |
| SEQ ID NO: 3271 VH | D-H.47 | EVQLVESGGGLVQPRGSLRLSCAVSGFTFRSYGMS<br>WVRQAPGKGLEWVALISSGGSYTYYTDSVKGRFTI<br>SRDNSKNTLYLQMNNLRAEGTAVYYCSRHGGNFFD<br>YWGQGTTVTVSS |
| SEQ ID NO: 3272 VH | D-H.48 | EVQLVESGGGLVQPRGSLRLSCAVSGFTFRSYGMS<br>WVRQAPGKGLEWVALISSGGSYTYYTDSVKGRFTI<br>SRDNSKNTLYLQMNNLRAEGTAAYYCSRHGGNFFD<br>YWGQGTTVTVSS |
| SEQ ID NO: 3273 VH | D-H.49 | QVQLVQSGAEVKKPGASVKVSCKVSGFTFRSYGMS<br>WVRQAPGKGLEWVALISSGGSYTYYTDSVKGRFTI<br>TRDNSTNTLYMELSSLRSEDTAVYYCSRHGGNFFD<br>YWGQGTTVTVSS |
| SEQ ID NO: 3274 VH | D-H.50 | QVQLVQSGSELKKPGASVKVSCKVSGFTFRSYGMS<br>WVRQAPGQGLEWVALISSGGSYTYYTDSVKGRFVI<br>SRDNSVNTLYLQISSLKAEDTAVYYCSRHGGNFFD<br>YWGQGTTVTVSS |

In some embodiments, the anti-TCRβ V10 antibody molecule comprises a VH or a VL of an antibody described in Table 12, or a sequence with at least 80%, 85%, 90%, 95%, 96%, 97%, 98%, 99% or more identity thereto.

In some embodiments, the anti-TCRβ V10 antibody molecule comprises a VH and a VL of an antibody described in Table 12, or a sequence with at least 80%, 85%, 90%, 95%, 96%, 97%, 98%, 99% or more identity thereto.

Antibody Molecules

In one embodiment, the antibody molecule binds to a cancer antigen, e.g., a tumor antigen or a stromal antigen. In some embodiments, the cancer antigen is, e.g., a mammalian, e.g., a human, cancer antigen. In other embodiments, the antibody molecule binds to an immune cell antigen, e.g., a mammalian, e.g., a human, immune cell antigen. For example, the antibody molecule binds specifically to an epitope, e.g., linear or conformational epitope, on the cancer antigen or the immune cell antigen.

In an embodiment, an antibody molecule is a monospecific antibody molecule and binds a single epitope. E.g., a monospecific antibody molecule having a plurality of immunoglobulin variable domain sequences, each of which binds the same epitope.

In an embodiment an antibody molecule is a multispecific or multifunctional antibody molecule, e.g., it comprises a plurality of immunoglobulin variable domains sequences, wherein a first immunoglobulin variable domain sequence of the plurality has binding specificity for a first epitope and a second immunoglobulin variable domain sequence of the plurality has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., the different proteins (or different subunits of a multimeric protein). In an embodiment a multispecific antibody molecule comprises a third, fourth or fifth immunoglobulin variable domain. In an embodiment, a multispecific antibody molecule is a bispecific antibody molecule, a trispecific antibody molecule, or a tetraspecific antibody molecule.

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., the different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv or a Fab, or fragment thereof, have binding specificity for a first epitope and a scFv or a Fab, or fragment thereof, have binding specificity for a second epitope.

In an embodiment, an antibody molecule comprises a diabody, and a single-chain molecule, as well as an antigen-binding fragment of an antibody (e.g., Fab, F(ab')$_2$, and Fv). For example, an antibody molecule can include a heavy (H) chain variable domain sequence (abbreviated herein as VH), and a light (L) chain variable domain sequence (abbreviated herein as VL). In an embodiment an antibody molecule comprises or consists of a heavy chain and a light chain (referred to herein as a half antibody). In another example, an antibody molecule includes two heavy (H) chain variable domain sequences and two light (L) chain variable domain sequence, thereby forming two antigen binding sites, such as Fab, Fab', F(ab')$_2$, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments retain the ability to selectively bind with their respective antigen or receptor. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. The a preparation of antibody molecules can be monoclonal or polyclonal. An antibody molecule can also be a human, humanized, CDR-grafted, or in vitro generated antibody. The antibody can have a heavy chain constant region chosen from, e.g., IgG1, IgG2, IgG3, or IgG4. The antibody can also have a light chain chosen from, e.g., kappa or lambda. The term "immunoglobulin" (Ig) is used interchangeably with the term "antibody" herein.

Examples of antigen-binding fragments of an antibody molecule include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) *Science* 242:423-426; and Huston et al. (1988) *Proc. Natl. Acad. Sci. USA* 85:5879-5883); (viii) a single domain antibody. These antibody fragments are obtained using conventional techniques known to those with skill in the art, and the fragments are screened for utility in the same manner as are intact antibodies.

Antibody molecules include intact molecules as well as functional fragments thereof. Constant regions of the antibody molecules can be altered, e.g., mutated, to modify the properties of the antibody (e.g., to increase or decrease one or more of: Fc receptor binding, antibody glycosylation, the number of cysteine residues, effector cell function, or complement function).

Antibody molecules can also be single domain antibodies. Single domain antibodies can include antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, fish, shark, goat, rabbit, and bovine. According to another aspect of the invention, a single domain antibody is a naturally occurring single domain antibody known as heavy chain antibody devoid of light chains. Such single domain antibodies are disclosed in WO 9404678, for example. For clarity reasons, this variable domain derived from a heavy chain antibody naturally devoid of light chain is known herein as a VHH or nanobody to distinguish it from the conventional VH of four chain immunoglobulins. Such a VHH molecule can be derived from antibodies raised in Camelidae species, for example in camel, llama, dromedary, alpaca and guanaco. Other species besides Camelidae may produce heavy chain antibodies naturally devoid of light chain; such VHHs are within the scope of the invention.

The VH and VL regions can be subdivided into regions of hypervariability, termed "complementarity determining regions" (CDR), interspersed with regions that are more conserved, termed "framework regions" (FR or FW).

The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) *J. Mol. Biol.* 196:901-917; and the AbM definition used by Oxford Molecular's AbM antibody modeling software. See, generally, e.g., *Protein Sequence and Structure Analysis of Antibody Variable Domains*. In: Antibody Engineering Lab Manual (Ed.: Duebel, S. and Kontermann, R., Springer-Verlag, Heidelberg).

The terms "complementarity determining region," and "CDR," as used herein refer to the sequences of amino acids within antibody variable regions which confer antigen specificity and binding affinity. In general, there are three CDRs in each heavy chain variable region (HCDR1, HCDR2, HCDR3) and three CDRs in each light chain variable region (LCDR1, LCDR2, LCDR3).

The precise amino acid sequence boundaries of a given CDR can be determined using any of a number of known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) *JMB* 273,927-948 ("Chothia" numbering scheme). As used herein, the CDRs defined according to the "Chothia" number scheme are also sometimes referred to as "hypervariable loops."

For example, under Kabat, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under Chothia, the CDR amino acids in the VH are numbered 26-32 (HCDR1), 52-56 (HCDR2), and 95-102 (HCDR3); and the amino acid residues in VL are numbered 26-32 (LCDR1), 50-52 (LCDR2), and 91-96 (LCDR3).

Each VH and VL typically includes three CDRs and four FRs, arranged from amino-terminus to carboxy-terminus in the following order: FR1, CDR1, FR2, CDR2, FR3, CDR3, FR4.

The antibody molecule can be a polyclonal or a monoclonal antibody.

The terms "monoclonal antibody" or "monoclonal antibody composition" as used herein refer to a preparation of antibody molecules of single molecular composition. A monoclonal antibody composition displays a single binding specificity and affinity for a particular epitope. A monoclonal antibody can be made by hybridoma technology or by methods that do not use hybridoma technology (e.g., recombinant methods).

The antibody can be recombinantly produced, e.g., produced by phage display or by combinatorial methods, or by yeast display.

Phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffths et al. (1993) *EMBO J* 12:725-734; Hawkins et al. (1992) *J Mot Biol* 226:889-896; Clackson et al. (1991) *Nature* 352:624-628; Gram et al. (1992) *PNAS* 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982, the contents of all of which are incorporated by reference herein).

The yeast display method for generating or identifying antibodies is known in the art, e.g., as described in Chao et al. (2006) *Nature Protocols* 1(2):755-68, the entire contents of which is incorporated by reference herein.

In one embodiment, the antibody is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody. Preferably, the non-human antibody is a rodent (mouse or rat antibody). Methods of producing rodent antibodies are known in the art.

Human monoclonal antibodies can be generated using transgenic mice carrying the human immunoglobulin genes rather than the mouse system. Splenocytes from these transgenic mice immunized with the antigen of interest are used to produce hybridomas that secrete human mAbs with specific affinities for epitopes from a human protein (see, e.g., Wood et al. International Application WO 91/00906, Kucherlapati et al. PCT publication WO 91/10741; Lonberg et al. International Application WO 92/03918; Kay et al. International Application 92/03917; Lonberg, N. et al. 1994 *Nature* 368:856-859; Green, L. L. et al. 1994 *Nature Genet.* 7:13-21; Morrison, S. L. et al. 1994 *Proc. Natl. Acad. Sci. USA* 81:6851-6855; Bruggeman et al. 1993 *Year Immunol* 7:33-40; Tuaillon et al. 1993 *PNAS* 90:3720-3724; Bruggeman et al. 1991 *Eur J Immunol* 21:1323-1326).

An antibody molecule can be one in which the variable region, or a portion thereof, e.g., the CDRs, are generated in a non-human organism, e.g., a rat or mouse. Chimeric, CDR-grafted, and humanized antibodies are within the invention. Antibody molecules generated in a non human organism, e.g., a rat or mouse, and then modified, e.g., in the variable framework or constant region, to decrease antigenicity in a human are within the invention.

An "effectively human" protein is a protein that does substantially not evoke a neutralizing antibody response, e.g., the human anti-murine antibody (HAMA) response. HAMA can be problematic in a number of circumstances, e.g., if the antibody molecule is administered repeatedly, e.g., in treatment of a chronic or recurrent disease condition. A HAMA response can make repeated antibody administration potentially ineffective because of an increased antibody clearance from the serum (see, e.g., Saleh et al., *Cancer Immunol. Immunother.*, 32:180-190 (1990)) and also because of potential allergic reactions (see, e.g., LoBuglio et al., *Hybridoma*, 5:5117-5123 (1986)).

Chimeric antibodies can be produced by recombinant DNA techniques known in the art (see Robinson et al., International Patent Publication PCT/US86/02269; Akira, et al., European Patent Application 184,187; Taniguchi, M., European Patent Application 171,496; Morrison et al., European Patent Application 173,494; Neuberger et al., International Application WO 86/01533; Cabilly et al. U.S. Pat. No. 4,816,567; Cabilly et al., European Patent Application 125, 023; Better et al. (1988 *Science* 240:1041-1043); Liu et al. (1987) *PNAS* 84:3439-3443; Liu et al., 1987, *J. Immunol.* 139:3521-3526; Sun et al. (1987) *PNAS* 84:214-218; Nishimura et al., 1987, *Canc. Res.* 47:999-1005; Wood et al. (1985) *Nature* 314:446-449; and Shaw et al., 1988, *J. Natl Cancer Inst.* 80:1553-1559).

A humanized or CDR-grafted antibody will have at least one or two but generally all three recipient CDRs (of heavy and or light immuoglobulin chains) replaced with a donor CDR. The antibody may be replaced with at least a portion of a non-human CDR or only some of the CDRs may be replaced with non-human CDRs. It is only necessary to replace the number of CDRs required for binding to the antigen. Preferably, the donor will be a rodent antibody, e.g., a rat or mouse antibody, and the recipient will be a human framework or a human consensus framework. Typically, the immunoglobulin providing the CDRs is called the "donor" and the immunoglobulin providing the framework is called the "acceptor." In one embodiment, the donor immunoglobulin is a non-human (e.g., rodent). The acceptor framework is a naturally-occurring (e.g., a human) framework or a consensus framework, or a sequence about 85% or higher, preferably 90%, 95%, 99% or higher identical thereto.

As used herein, the term "consensus sequence" refers to the sequence formed from the most frequently occurring amino acids (or nucleotides) in a family of related sequences (See e.g., Winnaker, From Genes to Clones (Verlagsgesellschaft, Weinheim, Germany 1987). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody molecule can be humanized by methods known in the art (see e.g., Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762, the contents of all of which are hereby incorporated by reference).

Humanized or CDR-grafted antibody molecules can be produced by CDR-grafting or CDR substitution, wherein one, two, or all CDRs of an immunoglobulin chain can be replaced. See e.g., U.S. Pat. No. 5,225,539; Jones et al. 1986 *Nature* 321:552-525; Verhoeyan et al. 1988 *Science* 239: 1534; Beidler et al. 1988 *J. Immunol.* 141:4053-4060; Winter U.S. Pat. No. 5,225,539, the contents of all of which are hereby expressly incorporated by reference. Winter describes a CDR-grafting method which may be used to prepare the humanized antibodies of the present invention (UK Patent Application GB 2188638A, filed on Mar. 26, 1987; Winter U.S. Pat. No. 5,225,539), the contents of which is expressly incorporated by reference.

Also within the scope of the invention are humanized antibody molecules in which specific amino acids have been substituted, deleted or added. Criteria for selecting amino acids from the donor are described in U.S. Pat. No. 5,585, 089, e.g., columns 12-16 of U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

The antibody molecule can be a single chain antibody. A single-chain antibody (scFV) may be engineered (see, for example, Colcher, D. et al. (1999) *Ann NY Acad Sci* 880: 263-80; and Reiter, Y. (1996) *Clin Cancer Res* 2:245-52). The single chain antibody can be dimerized or multimerized to generate multivalent antibodies having specificities for different epitopes of the same target protein.

In yet other embodiments, the antibody molecule has a heavy chain constant region chosen from, e.g., the heavy chain constant regions of IgG1, IgG2, IgG3, IgG4, IgM, IgA1, IgA2, IgD, and IgE; particularly, chosen from, e.g., the (e.g., human) heavy chain constant regions of IgG1, IgG2, IgG3, and IgG4. In another embodiment, the antibody molecule has a light chain constant region chosen from, e.g., the (e.g., human) light chain constant regions of kappa or lambda. The constant region can be altered, e.g., mutated, to modify the properties of the antibody (e.g., to increase or decrease one or more of: Fc receptor binding, antibody glycosylation, the number of cysteine residues, effector cell function, and/or complement function). In one embodiment the antibody has: effector function; and can fix complement. In other embodiments the antibody does not; recruit effector cells; or fix complement. In another embodiment, the antibody has reduced or no ability to bind an Fc receptor. For example, it is a isotype or subtype, fragment or other mutant, which does not support binding to an Fc receptor, e.g., it has a mutagenized or deleted Fc receptor binding region.

Methods for altering an antibody constant region are known in the art. Antibodies with altered function, e.g. altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference). Similar type of alterations could be described which if applied to the murine, or other species immunoglobulin would reduce or eliminate these functions.

An antibody molecule can be derivatized or linked to another functional molecule (e.g., another peptide or protein). As used herein, a "derivatized" antibody molecule is one that has been modified. Methods of derivatization include but are not limited to the addition of a fluorescent moiety, a radionucleotide, a toxin, an enzyme or an affinity ligand such as biotin. Accordingly, the antibody molecules of the invention are intended to include derivatized and otherwise modified forms of the antibodies described herein, including immunoadhesion molecules. For example, an antibody molecule can be functionally linked (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate association of the antibody or antibody portion with another molecule (such as a streptavidin core region or a polyhistidine tag).

One type of derivatized antibody molecule is produced by crosslinking two or more antibodies (of the same type or of different types, e.g., to create bispecific antibodies). Suitable crosslinkers include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

Multispecific or Multifunctional Antibody Molecules

Exemplary structures of multispecific and multifunctional molecules defined herein are described throughout. Exemplary structures are further described in: Weidle U et al. (2013) The Intriguing Options of Multispecific Antibody Formats for Treatment of Cancer. *Cancer Genomics & Proteomics* 10: 1-18 (2013); and Spiess C et al. (2015) Alternative molecular formats and therapeutic applications for bispecific antibodies. *Molecular Immunology* 67: 95-106; the full contents of each of which is incorporated by reference herein).

In embodiments, multispecific antibody molecules can comprise more than one antigen-binding site, where different sites are specific for different antigens. In embodiments, multispecific antibody molecules can bind more than one (e.g., two or more) epitopes on the same antigen. In embodiments, multispecific antibody molecules comprise an antigen-binding site specific for a target cell (e.g., cancer cell) and a different antigen-binding site specific for an immune effector cell. In one embodiment, the multispecific antibody molecule is a bispecific antibody molecule. Bispecific antibody molecules can be classified into five different structural groups: (i) bispecific immunoglobulin G (BsIgG); (ii) IgG appended with an additional antigen-binding moiety; (iii) bispecific antibody fragments; (iv) bispecific fusion proteins; and (v) bispecific antibody conjugates.

BsIgG is a format that is monovalent for each antigen. Exemplary BsIgG formats include but are not limited to crossMab, DAF (two-in-one), DAF (four-in-one), DutaMab, DT-IgG, knobs-in-holes common LC, knobs-in-holes assembly, charge pair, Fab-arm exchange, SEEDbody, triomab, LUZ-Y, Fcab, xX-body, orthogonal Fab. See Spiess et al. Mol. Immunol. 67(2015):95-106. Exemplary BsIgGs include catumaxomab (Fresenius Biotech, Trion Pharma, Neopharm), which contains an anti-CD3 arm and an anti-EpCAM arm; and ertumaxomab (Neovii Biotech, Fresenius Biotech), which targets CD3 and HER2. In some embodiments, BsIgG comprises heavy chains that are engineered for heterodimerization. For example, heavy chains can be engineered for heterodimerization using a "knobs-into-holes" strategy, a SEED platform, a common heavy chain (e.g., in KX-bodies), and use of heterodimeric Fc regions. See Spiess et al. Mol. Immunol. 67(2015):95-106. Strategies that have been used to avoid heavy chain pairing of homodimers in BsIgG include knobs-in-holes, duobody, azymetric, charge pair, HA-TF, SEEDbody, and differential protein A affinity. See Id. BsIgG can be produced by separate expression of the component antibodies in different host cells and subsequent purification/assembly into a BsIgG. BsIgG can also be produced by expression of the component antibodies in a single host cell. BsIgG can be purified using affinity chromatography, e.g., using protein A and sequential pH elution.

IgG appended with an additional antigen-binding moiety is another format of bispecific antibody molecules. For example, monospecific IgG can be engineered to have bispecificity by appending an additional antigen-binding unit onto the monospecific IgG, e.g., at the N- or C-terminus of either the heavy or light chain. Exemplary additional antigen-binding units include single domain antibodies (e.g., variable heavy chain or variable light chain), engineered protein scaffolds, and paired antibody variable domains (e.g., single chain variable fragments or variable fragments). See Id. Examples of appended IgG formats include dual variable domain IgG (DVD-Ig), IgG(H)-scFv, scFv-(H)IgG, IgG(L)-scFv, scFv-(L)IgG, IgG(L,H)-Fv, IgG(H)-V, V(H)—IgG, IgG(L)-V, V(L)-IgG, KIH IgG-scFab, 2scFv-IgG, IgG-2scFv, scFv4-Ig, zybody, and DVI-IgG (four-in-one). See Spiess et al. Mol. Immunol. 67(2015):95-106. An example of an IgG-scFv is MM-141 (Merrimack Pharmaceuticals), which binds IGF-1R and HER3. Examples of DVD-Ig include ABT-981 (AbbVie), which binds IL-1a and IL-10; and ABT-122 (AbbVie), which binds TNF and IL-17A.

Bispecific antibody fragments (BsAb) are a format of bispecific antibody molecules that lack some or all of the antibody constant domains. For example, some BsAb lack an Fc region. In embodiments, bispecific antibody fragments include heavy and light chain regions that are connected by a peptide linker that permits efficient expression of the BsAb in a single host cell. Exemplary bispecific antibody fragments include but are not limited to nanobody, nanobody-HAS, BiTE, Diabody, DART, TandAb, scDiabody, scDiabody-CH3, Diabody-CH3, triple body, miniantibody, minibody, TriBi minibody, scFv-CH3 KIH, Fab-scFv, scFv-CH-CL-scFv, F(ab')2, F(ab')2-scFv2, scFv-KIH, Fab-scFv-Fc, tetravalent HCAb, scDiabody-Fc, Diabody-Fc, tandem scFv-Fc, and intrabody. See Id. For example, the BiTE format comprises tandem scFvs, where the component scFvs bind to CD3 on T cells and a surface antigen on cancer cells Bispecific fusion proteins include antibody fragments linked to other proteins, e.g., to add additional specificity and/or functionality. An example of a bispecific fusion protein is an immTAC, which comprises an anti-CD3 scFv linked to an affinity-matured T-cell receptor that recognizes HLA-presented peptides. In embodiments, the dock-and-lock (DNL) method can be used to generate bispecific antibody molecules with higher valency. Also, fusions to albumin binding proteins or human serum albumin can be extend the serum half-life of antibody fragments. See Id.

In embodiments, chemical conjugation, e.g., chemical conjugation of antibodies and/or antibody fragments, can be used to create BsAb molecules. See Id. An exemplary bispecific antibody conjugate includes the CovX-body format, in which a low molecular weight drug is conjugated site-specifically to a single reactive lysine in each Fab arm or an antibody or fragment thereof. In embodiments, the conjugation improves the serum half-life of the low molecular weight drug. An exemplary CovX-body is CVX-241 (NCT01004822), which comprises an antibody conjugated to two short peptides inhibiting either VEGF or Ang2. See Id.

The antibody molecules can be produced by recombinant expression, e.g., of at least one or more component, in a host system. Exemplary host systems include eukaryotic cells (e.g., mammalian cells, e.g., CHO cells, or insect cells, e.g., SF9 or S2 cells) and prokaryotic cells (e.g., *E. coli*). Bispecific antibody molecules can be produced by separate expression of the components in different host cells and subsequent purification/assembly. Alternatively, the antibody molecules can be produced by expression of the components in a single host cell. Purification of bispecific antibody molecules can be performed by various methods such as affinity chromatography, e.g., using protein A and sequential pH elution. In other embodiments, affinity tags can be used for purification, e.g., histidine-containing tag, myc tag, or streptavidin tag.

Exemplary Bispecific Molecules

In an aspect, a multispecific molecule disclosed herein comprises a sequence disclosed herein, e.g., a sequence chosen from SEQ ID NOs: 1004-1007, 3275-3277, 3286, or 3287, or a sequence with at least 85%, 90%, 955, 96%, 97%, 98%, 99% or more identity thereto. In some embodiments, a multispecific molecule disclosed herein comprises a leader sequence comprising the amino acid sequence of SEQ ID NO: 3288. In some embodiments, a multispecific molecule disclosed herein does not comprise a leader sequence comprising the amino acid sequence of SEQ ID NO: 3288.

Molecule F: aCD19 x aVb6.5

Molecule F comprises a heavy chain comprising the amino acid sequence of SEQ ID NO: 1004 and a light chain comprising the amino acid sequence of SEQ ID NO: 1005.

Molecule F.1

SEQ ID NO: 1004 (heavy chain) (Tcrvbeta6_5 scFv/anti-CD19 heavy chain)
METDTLLLWVLLLWVPGSTGQVQLVQS-GAEVKKPGSSVKVSCKASGYSFT-TYYIHWVRQAPGQGLEWMGWFFPGS GNIKYNEKFKGRVTITADTSTSTAYMELSSLRSED-TAVYY-CAGSYYSYDVLDYWGQGTTVTVSSGGGGSGGG-GSGGGG SGGGGSDIQMTQSPSFLSASVGDRVTITCK-ASQNVGINVVWHQQKPGKAPKAL-IYSSSHRYSGVPSRFSGSGSGTEFTL TISSLQPEDFA-TYFCQQFKSYPLTFGQGTKLEIKGGGGSQVTLR-ESGPALVKPTQTLTLTCTFSGFSLSTSGMGVGWIRQP PGKALEWLAHIWWDDDKRYN-PALKSRLTISKDTSKNQVFLTMTNMDPVDTATYY-CARMELWSYYFDYWGQGTTVT VSSASTKGPSVF-PLAPSSKSTSGGTAALGCLVKDYFPEPVTVSWNS-GALTSGVHTFPAVLQSSGLYSLSSVVTVPSSSLGT QTYICNVNHKPSNTKVDKKVEPKSCDKTHTCPPCPA-PELLGGPSVFLFPPKPKDTLMISRTPE-VTCVVVDVSHEDPEVKF NWYVDGVEVHNAKTKPRE-EQYASTYRVVSVLTVLHQDWLNGKEYKCKVSNKA-LPAPIEKTISKAKGQPREPQVYTLPP SREEMT-KNQVSLTCLVKGFYPSDIAVEWESNGQPENNYK-TTPPVLDSDGSFFLYSK-LTVDKSRWQQGNVFSCSVMHE ALHNHYTQKSLSL-SPGK Molecule F.2

SEQ ID NO: 1005 (light chain) (anti-CD 19 light chain)
METPAQLLFLLLLWLPDTTGENVLTQSPATLSL-SPGER-ATLSCSASSSVSYMHWYQQKPGQAPRLLIYDTSK-LASGIPAR FSGSGSGTDHTLTISSLEPED-FAVYYCFQGSVYPFTFGQGTKLEIKRTVAAPSVFIFPPS-DEQLKSGTASVVCLLNNFYPRE AKVQWKVD-NALQSGNSQESVTEQDSKDSTYSLSSTLTLSKA-DYEKHKVYACEVTHQGLSSPVTKSFNRGEC In an aspect, a multispecific molecule disclosed herein comprises SEQ ID NO: 1004 and/or SEQ ID NO: 1005 or a sequence with at least 85%, 90%, 955, 96%, 97%, 98%, 99% or more identity thereto.

Molecule G: aBCMA x aVb6.5

Molecule G comprises a heavy chain comprising the amino acid sequence of SEQ ID NO: 1006 and a light chain comprising the amino acid sequence of SEQ ID NO: 1007.

Molecule G.1

SEQ ID NO: 1006 (heavy chain)
METDTLLLWVLLLWVPGSTGQVQLVQS-GAEVKKPGSSVKVSCKASGYSFT-TYYIHWVRQAPGQGLEWMGWFFPGS GNIKYNEKFKGRVTITADTSTSTAYMELSSLRSED-TAVYY-CAGSYYSYDVLDYWGQGTTVTVSSGGGGSGGG-GSGGGG SGGGGSDIQMTQSPSFLSASVGDRVTITCK-ASQNVGINVVWHQQKPGKAPKAL-IYSSSHRYSGVPSRFSGSGSGTEFTL TISSLQPEDFA-TYFCQQFKSYPLTFGQGTKLEIKGGGGSQVQLVE-SGGGVVQPGRSLRLSCAASGIDFSRYWMSWVRQ APGKGLEWVGEINPDSSTINYAPSLKDRFTIS-RDNSKNTLYLQMSSLRAEDTAVYY-CASLYYDYGDAMDYWGQGTTVT VSSASTKGPSVF-PLAPSSKSTSGGTAALGCLVKDYFPEPVTVSWNS-GALTSGVHTFPAVLQSSGLYSLSSVVTVPSSSLGT QTYICNVNHKPSNTKVDKKVEPKSCDKTHTCPPCPA-PELLGGPSVFLFPPKPKDTLMISRTPE-VTCVVVDVSHEDPEVKF NWYVDGVEVHNAKTKPRE-EQYASTYRVVSVLTVLHQDWLNGKEYKCKVSNKA-LPAPIEKTISKAKGQPREPQVYTLPP SREEMT-KNQVSLTCLVKGFYPSDIAVEWESNGQPENNYK-TTPPVLDSDGSFFLYSK-LTVDKSRWQQGNVFSCSVMHE ALHNRFTQKSLSL-SPGK Molecule G.2

SEQ ID NO: 1007 (light chain)
METDTLLLWVLLLWVPGSTGDIQMTQSPSSL-SASVGDRVTITCKASQSVDSNVAWYQQKPEKAPKA-LIFSASLRFSGVP SRFSGSGSGTDFTLTISSLQPEDFA-TYFCQQYNNYPLTFGQGTKLEIKRTVAAPSVFIFPPSD-EQLKSGTASVVCLLNNFYP REAKVQWKVDNALQSGNSQESVTEQDSKDSTYS-LSSTLTLSKADYEKHKVYACE-VTHQGLSSPVTKSFNRGEC In an aspect, a multispecific molecule disclosed herein comprises SEQ ID NO: 1006 and/or SEQ ID NO: 1007 or a sequence with at least 85%, 90%, 955, 96%, 97%, 98%, 99% or more identity thereto.

Molecule H: aBCMA x aTCRvbeta6_5

Molecule H comprises a first heavy chain comprising the amino acid sequence of SEQ ID NO: 3275, a light chain comprising the amino acid sequence of SEQ ID NO: 3277, and a second heavy chain comprising the amino acid sequence of SEQ ID NO: 3276.

Molecule H.1

SEQ ID NO: 3275 (anti-BCMA heavy chain)
METDTLLLWVLLLWVPGSTGQVQLVES-GGGVVQPGRSLRLS-CAASGIDFSRYWMSWVRQAPGKGLEWVGEINPDSS TINYAPSLKDRFTISRDNSKNTLYLQMSSLRAED-TAVYYCASLYYDYGDAMDYWGQGTTVTVSSAS-TKGPSVFPLAPSSK STSGGTAALGCLVKDYF-PEPVTVSWNSGALTSGVHTFPAVLQSSGLYSLSSV-VTVPSSSLGTQTYICNVNHKPSNTKVDK RVE-PKSCDKTHTCPPCPA-PELLGGPSVFLFPPKPKDTLMISRTPE-VTCVVVDVSHEDPEVKFNWYVDGVEVHNAKTKPR EEQYNA-TYRVVSVLTVLHQDWLNGKEYKCKVSNKALPA-PIEKTISKAKGQPREPQVYTLPPCREEMT-KNQVSLWCLVK GFYPSDIAVEWESNGQPENNYKTTPPVLDSDGSFFLY-SKLTVDKSRWQQGNVFSCSVMHEALHN-HYTQKSLSLSPGK Molecule H.2
SEQ ID NO: 3276 (TCRvbeta_6_5 scFv humanized)
METDTLLLLWVLLLWVPGSTGQVQLVQS-
GAEVKKPGSSVKVSCKASGYSFT-
TYYIHWVRQAPGQGLEWMGWFFPGS
GNIKYNEKFKGRVTITADTSTSTAYMELSSLRSED-
TAVYY-
CAGSYYSYDVLDYWGQGTTVTVSSGGGGSGG-
GGSGGGG SGGGGSDIQMTQSPSFL-
SASVGDRVTITCKASQNVGINVVWHQQKPGKAPKA-
LIYSSSHRYSGVPSRFSGSGSGTEFTL TISSLQPEDFA-
TYFCQQFKSYPLTFGQGTKLEIKGGGGSGGGGSD-
KTHTCPPCPAPELLGGPSVFLFPPKPKDTLMISRTP
EVTCVVVDVSHEDPE-
VKFNWYVDGVEVHNAKTKPRE-
EQYASTYRVVSVLTVLHQDWLNGKEYKCKVSNKA-
LPAPIEKT
ISKAKGQPREPQVCTLPPSREEMTKNQVSLSCAV-
KGFYPSDIAVEWESNGQPENNYKTTPPVLDSDGSF-
FLVSKLTVDK SRWQQGNVFSCSVMHEALHN-
HYTQKSLSLSPGK Molecule H.3
SEQ ID NO: 3277 (anti-BCMA light chain)
METDTLLLLWVLLLWVPGSTGDIQMTQSPSSL-
SASVGDRVTITCKASQSVDSNVAWYQQKPEKAPKA-
LIFSASLRFSGVP SRFSGSGSGTDFTLTISSLQPEDFA-
TYFCQQYNNYPLTFGQGTKLEIKRTVAAPSVFIFPPSD-
EQLKSGTASVVCLLNNFYP
REAKVQWKVDNALQSGNSQESVTEQDSKDSTYS-
LSSTLTLSKADYEKHKVYACE-
VTHQGLSSPVTKSFNRGEC In an aspect, a multispecific molecule disclosed herein comprises SEQ ID NO: 3275, SEQ ID NO: 3276, and/or SEQ ID NO: 3277 or a sequence with at least 85%, 90%, 955, 96%, 97%, 98%, 99% or more identity thereto.

Molecule I: Half Arm BCMA Fab with c-Terminal scFv TCRvbeta
Molecule I comprises a first heavy chain comprising the amino acid sequence of SEQ ID NO: 3286, a light chain comprising the amino acid sequence of SEQ ID NO: 3277, and a second heavy chain comprising the amino acid sequence of SEQ ID NO: 3287.

Molecule I.1
SEQ ID NO: 3286 (heavy chain 1)

METDTLLLWVLLLWVPGSTGQVQLVESGGGVVQPGRSLRLSCAASGIDFS

RYWMSWVRQAPGKGLEWVGEINPDSSTINYAPSLKDRFTISRDNSKNTLY

LQMSSLRAEDTAVYYCASLYYDYGDAMDYWGQGTTVTVSSASTKGPSVFP

LAPSSKSTSGGTAALGCLVKDYFPEPVTVSWNSGALTSGVHTFPAVLQSS

GLYSLSSVVTVPSSSLGTQTYICNVNHKPSNTKVDKRVEPKSCDKTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPCREEMTKNQVSLWCLVKGFYPSDI

AVEWESNGQPENNYKTTPPVLDSDGSFFLYSKLTVDKSRWQQGNVFSCSV

MHEALHNHYTQKSLSLSPGKGGGGSGGGGSGGGGSEVQLVESGGGLVQPG

GSLRLSCAASGFTFSTYAMNWVRQAPGKGLEWVSRIRSKYNNYATYYADS

VKDRFTISRDDSKNTLYLQMNSLKTEDTAVYYCVRHGNFGNSYVSWFAYW

GQGTLVTVSSGGGGSGGGGSGGGGSGGGGSQAVVTQEPSLTVSPGGTVTL

TCRSSTGAVTTSNYANWVQQKPGQAPRGLIGGTNKRAPWTPARFSGSLLG

GKAALTLSGAQPEDEAEYYCALWYSNLWVFGGGTKLTVL

Molecule I.2
SEQ ID NO: 3277 (light chain)

METDTLLLWVLLLWVPGSTGDIQMTQSPSSLSASVGDRVTITCKASQSVD

SNVAWYQQKPEKAPKALIFSASLRFSGVPSRFSGSGSGTDFTLTISSLQP

EDFATYFCQQYNNYPLTFGQGTKLEIKRTVAAPSVFIFPPSDEQLKSGTA

SVVCLLNNFYPREAKVQWKVDNALQSGNSQESVTEQDSKDSTYSLSSTLT

LSKADYEKHKVYACEVTHQGLSSPVTKSFNRGEC

Molecule I.3
SEQ ID NO: 3287 (heavy chain 2)

METDTLLLWVLLLWVPGSTGDKTHTCPPCPAPELLGGPSVFLFPPKPKDT

LMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVCT

LPPSREEMTKNQVSLSCAVKGFYPSDIAVEWESNGQPENNYKTTPPVLDS

DGSFFLVSKLTVDKSRWQQGNVFSCSVMHEALHNHYTQKSLSLSPGK

In an aspect, a multispecific molecule disclosed herein comprises SEQ ID NO: 3286, SEQ ID NO: 3277, and/or SEQ ID NO: 3287 or a sequence with at least 85%, 90%, 955, 96%, 97%, 98%, 99% or more identity thereto.

Antibody-Like Frameworks or Scaffolds

A wide variety of antibody/immunoglobulin frameworks or scaffolds can be employed in the anti-TCRvb antibody molecules disclosed herein or multifunctional formats thereof so long as the resulting polypeptide includes at least one binding region which specifically binds to the target antigen, e.g., a TCRvb, a tumor antigen, among others. Such frameworks or scaffolds include the 5 main idiotypes of human immunoglobulins, or fragments thereof, and include immunoglobulins of other animal species, preferably having humanized aspects. Novel frameworks, scaffolds and fragments continue to be discovered and developed by those skilled in the art.

In one embodiment, the anti-TCRvb antibody molecules disclosed herein or multifunctional formats thereof include non-immunoglobulin based antibodies using non-immunoglobulin scaffolds onto which CDRs can be grafted. Any non-immunoglobulin frameworks and scaffolds may be employed, as long as they comprise a binding region specific for the target antigen (e.g., TCRvb or a tumor antigen). Exemplary non-immunoglobulin frameworks or scaffolds include, but are not limited to, fibronectin (Compound Therapeutics, Inc., Waltham, MA), ankyrin (Molecular Partners AG, Zurich, Switzerland), domain antibodies (Domantis, Ltd., Cambridge, MA, and Ablynx nv, Zwijnaarde, Belgium), lipocalin (Pieris Proteolab AG, Freising, Germany), small modular immuno-pharmaceuticals (Trubion Pharmaceuticals Inc., Seattle, WA), maxybodies (Avidia, Inc., Mountain View, CA), Protein A (Affibody AG, Sweden), and affilin (gamma-crystallin or ubiquitin) (Scil Proteins GmbH, Halle, Germany).

Fibronectin scaffolds are typically based on fibronectin type III domain (e.g., the tenth module of the fibronectin type III (10 Fn3 domain)). The fibronectin type III domain has 7 or 8 beta strands which are distributed between two beta sheets, which themselves pack against each other to form the core of the protein, and further containing loops (analogous to CDRs) which connect the beta strands to each other and are solvent exposed. There are at least three such loops at each edge of the beta sheet sandwich, where the edge is the boundary of the protein perpendicular to the direction of the beta strands (see U.S. Pat. No. 6,818,418). Because of this structure, the non-immunoglobulin antibody mimics antigen binding properties that are similar in nature and affinity to those of antibodies. These scaffolds can be used in a loop randomization and shuffling strategy in vitro that is similar to the process of affinity maturation of antibodies in vivo. These fibronectin-based molecules can be used as scaffolds where the loop regions of the molecule can be replaced with CDRs of the invention using standard cloning techniques. The ankyrin technology is based on using proteins with ankyrin derived repeat modules as scaffolds for bearing variable regions which can be used for binding to different targets. The ankyrin repeat module typically is a about 33 amino acid polypeptide consisting of two anti-parallel α-helices and a β-turn. Binding of the variable regions can be optimized by using ribosome display.

Avimers are used by nature for protein-protein interactions and in human over 250 proteins are structurally based on A-domains. Avimers consist of a number of different "A-domain" monomers (2-10) linked via amino acid linkers. Avimers can be created that can bind to the target antigen using the methodology described in, for example, U.S. Patent Application Publication Nos. 20040175756; 20050053973; 20050048512; and 20060008844.

Affibody affinity ligands are small, simple proteins composed of a three-helix bundle based on the scaffold of one of the IgG-binding domains of Protein A. Protein A is a surface protein from the bacterium *Staphylococcus aureus*. This scaffold domain consists of 58 amino acids, 13 of which are randomized to generate affibody libraries with a large number of ligand variants (See e.g., U.S. Pat. No. 5,831,012). Affibody molecules mimic antibodies, they have a molecular weight of 6 kDa, compared to the molecular weight of antibodies, which is 150 kDa. In spite of its small size, the binding site of affibody molecules is similar to that of an antibody.

Anticalins are known commercially, e.g., Pieris Proteo-Lab AG. They are derived from lipocalins, a widespread group of small and robust proteins that are usually involved in the physiological transport or storage of chemically sensitive or insoluble compounds. Several natural lipocalins occur in human tissues or body liquids. The protein architecture is reminiscent of immunoglobulins, with hypervariable loops on top of a rigid framework. However, in contrast with antibodies or their recombinant fragments, lipocalins are composed of a single polypeptide chain with 160 to 180 amino acid residues, being just marginally bigger than a single immunoglobulin domain. The set of four loops, which makes up the binding pocket, shows pronounced structural plasticity and tolerates a variety of side chains. The binding site can thus be reshaped in a proprietary process in order to recognize prescribed target molecules of different shape with high affinity and specificity. One protein of lipocalin family, the bilin-binding protein (BBP) of *Pieris Brassicae* has been used to develop anticalins by mutagenizing the set of four loops. One example of a patent application describing anticalins is in PCT Publication No. WO 199916873.

Affilin molecules are small non-immunoglobulin proteins which are designed for specific affinities towards proteins and small molecules. New affilin molecules can be very quickly selected from two libraries, each of which is based on a different human derived scaffold protein. Affilin molecules do not show any structural homology to immunoglobulin proteins. Currently, two affilin scaffolds are employed, one of which is gamma crystalline, a human structural eye lens protein and the other is "ubiquitin" superfamily proteins. Both human scaffolds are very small, show high temperature stability and are almost resistant to pH changes and denaturing agents. This high stability is mainly due to the expanded beta sheet structure of the proteins. Examples of gamma crystalline derived proteins are described in WO200104144 and examples of "ubiquitin-like" proteins are described in WO2004106368.

Protein epitope mimetics (PEM) are medium-sized, cyclic, peptide-like molecules (MW 1-2 kDa) mimicking beta-hairpin secondary structures of proteins, the major secondary structure involved in protein-protein interactions.

Domain antibodies (dAbs) can be used in the anti-TCRvb antibody molecules disclosed herein or multifunctional formats thereof are small functional binding fragments of antibodies, corresponding to the variable regions of either the heavy or light chains of antibodies. Domain antibodies are well expressed in bacterial, yeast, and mammalian cell systems. Further details of domain antibodies and methods of production thereof are known in the art (see, for example, U.S. Pat. Nos. 6,291,158; 6,582,915; 6,593,081; 6,172,197; 6,696,245; European Patents 0368684 & 0616640; WO05/035572, WO04/101790, WO04/081026, WO04/058821, WO04/003019 and WO03/002609. Nanobodies are derived from the heavy chains of an antibody.

A nanobody typically comprises a single variable domain and two constant domains (CH2 and CH3) and retains antigen-binding capacity of the original antibody. Nanobodies can be prepared by methods known in the art (See e.g., U.S. Pat. Nos. 6,765,087, 6,838,254, WO 06/079372). Unibodies consist of one light chain and one heavy chain of an IgG4 antibody. Unibodies may be made by the removal of the hinge region of IgG4 antibodies. Further details of unibodies and methods of preparing them may be found in WO2007/059782.

Tumor Antigen Moiety

In an aspect, provided herein is a multispecific molecule, e.g., a bispecific molecule, comprising:
 (i) a first moiety (e.g., a first immune cell engager) comprising the anti-TCRβV antibody molecule described herein; and
 (ii) a second moiety comprising one or more of: a tumor-targeting moiety; a second immune cell engager; a cytokine molecule or a stromal modifying moiety.

In some embodiments of any of the compositions or methods disclosed herein, the tumor-targeting moiety is an antigen, e.g., a cancer antigen. In some embodiments, the cancer antigen is a tumor antigen or stromal antigen, or a hematological antigen.

In some embodiments of any of the compositions or methods disclosed herein, the tumor-targeting moiety, e.g., cancer antigen, is chosen from: BCMA, FcRH5, CD19, CD20, CD22, CD30, CD33, CD38, CD47, CD99, CD123, FcRH5, CLEC12, CD179A, SLAMF7, or NY-ESO1, PDL1, CD47, ganglioside 2 (GD2), prostate stem cell antigen (PSCA), prostate specific membrane antigen (PMSA), prostate-specific antigen (PSA), carcinoembryonic antigen (CEA), Ron Kinase, c-Met, Immature laminin receptor, TAG-72, BING-4, Calcium-activated chloride channel 2, Cyclin-B1, 9D7, Ep-CAM, EphA3, Her2/neu, Telomerase, SAP-1, Survivin, NY-ESO-1/LAGE-1, PRAME, SSX-2, Melan-A/MART-1, Gp100/pme117, Tyrosinase, TRP-1/-2, MC1R, β-catenin, BRCA1/2, CDK4, CML66, Fibronectin, p53, Ras, TGF-B receptor, AFP, ETA, MAGE, MUC-1, CA-125, BAGE, GAGE, NY-ESO-1, f3-catenin, CDK4, CDC27, a actinin-4, TRP1/gp75, TRP2, gp 100, Melan-A/MART 1, gangliosides, WT 1, EphA3, Epidermal growth factor receptor (EGFR), MART-2, MART-1, MUC 1, MUC2, MUM 1, MUM2, MUM3, NA88-1, NPM, OA1, OGT, RCC, RUI1, RUI2, SAGE, TRG, TRP1, TSTA, Folate receptor alpha, L1-CAM, CAIX, gpA33, GD3, GM2, VEGFR, Intergrins (Integrin alphaVbeta3, Integrin alpha5Beta1), Carbohydrates (Le), IGF1R, EPHA3, TRAILR1, TRAILR2, RANKL, (FAP), TGF-beta, hyaluronic acid, collagen, e.g., collagen IV, tenascin C, or tenascin W. In some embodiments, the tumor-targeting moiety, e.g., cancer antigen, is BCMA. In some embodiments, the tumor-targeting moiety, e.g., cancer antigen, is FcRH5.

FcRH5 Targeting Moieties

In some embodiments, the multispecific molecules disclosed herein include a targeting moiety that binds to FcRH5 (e.g., a FcRH5 targeting moiety). The FcRH5 targeting moiety can be chosen from an antibody molecule (e.g., an antigen binding domain as described herein), a receptor or a receptor fragment, or a ligand or a ligand fragment, or a combination thereof. In some embodiments, the FcRH5 targeting moiety associates with, e.g., binds to, a cancer or hematopoietic cell (e.g., a molecule, e.g., antigen, present on the surface of the cancer or hematopoietic cell). In certain embodiments, the FcRH5 targeting moiety targets, e.g., directs the multi specific molecules disclosed herein to a cancer or hematopoietic cell. In some embodiments, the cancer is a hematological cancer, e.g., multiple myeloma.

In some embodiments, the multispecific molecule, e.g., the FcRH5 targeting moiety, binds to a FcRH5 antigen on the surface of a cell, e.g., a cancer or hematopoietic cell. The FcRH5 antigen can be present on a primary tumor cell, or a metastatic lesion thereof. In some embodiments, the cancer is a hematological cancer, e.g., multiple myeloma. For example, the FcRH5 antigen can be present on a tumor, e.g., a tumor of a class typified by having one or more of: limited tumor perfusion, compressed blood vessels, or fibrotic tumor interstitium.

The multispecific molecules described herein includes a FcRH5 targeting moiety that comprises an anti-FcRH5 antibody or antigen-binding fragment thereof described in U.S. Pat. No. 7,999,077, US20150098900, U.S. Pat. Nos. 8,299,220, 7,105,149, 8,362,213, 8,466,260, 8,617,559, US20160368985, US20150166661, and US20080247944, the entire contents of any of the aforesaid publications are herein incorporated by reference.

In some embodiments, the multispecific molecules described herein includes a FcRH5 targeting moiety that comprises an anti-FcRH5 antibody or antigen-binding fragment thereof described in U.S. Pat. No. 7,999,077, the entire contents of which are herein incorporated by reference.

BCMA Targeting Moieties

In certain embodiments, the multispecific molecules disclosed herein include a targeting moiety that binds to BCMA (e.g., a BCMA targeting moiety). The BCMA targeting moiety can be chosen from an antibody molecule (e.g., an antigen binding domain as described herein), a receptor or a receptor fragment, or a ligand or a ligand fragment, or a combination thereof. In some embodiments, the BCMA targeting moiety associates with, e.g., binds to, a cancer or hematopoietic cell (e.g., a molecule, e.g., antigen, present on the surface of the cancer or hematopoietic cell). In certain embodiments, the BCMA targeting moiety targets, e.g., directs the multi specific molecules disclosed herein to a cancer or hematopoietic cell. In some embodiments, the cancer is a hematological cancer, e.g., multiple myeloma.

In some embodiments, the multispecific molecule, e.g., the BCMA targeting moiety, binds to a BCMA antigen on the surface of a cell, e.g., a cancer or hematopoietic cell. The BCMA antigen can be present on a primary tumor cell, or a metastatic lesion thereof. In some embodiments, the cancer is a hematological cancer, e.g., multiple myeloma. For example, the BCMA antigen can be present on a tumor, e.g., a tumor of a class typified by having one or more of: limited tumor perfusion, compressed blood vessels, or fibrotic tumor interstitium.

Exemplary BCMA Targeting Moieties

The multispecific molecules described herein can include a BCMA targeting moiety that comprises an anti-BCMA antibody or antigen-binding fragment thereof described in U.S. Pat. Nos. 8,920,776, 9,243,058, 9,340,621, 8,846,042, 7,083,785, 9,545,086, 7,276,241, 9,034,324, 7,799,902, 9,387,237, 8,821,883, US861745, US20130273055, US20160176973, US20150368351, US20150376287, US20170022284, US20160015749, US20140242077, US20170037128, US20170051068, US20160368988, US20160311915, US20160131654, US20120213768, US20110177093, US20160297885, EP3137500, EP2699259, EP2982694, EP3029068, EP3023437, WO2016090327, WO2017021450, WO2016110584, WO2016118641, WO2016168149, the entire contents of which are incorporated herein by reference.

In one embodiment, the BCMA-targeting moiety includes an antibody molecule (e.g., Fab or scFv) that binds to BCMA. In some embodiments, the antibody molecule to BCMA comprises one, two, or three CDRs from any of the heavy chain variable domain sequences of Table 1, or a closely related CDR, e.g., CDRs which have at least one amino acid alteration, but not more than two, three or four alterations (e.g., substitutions, deletions, or insertions, e.g., conservative substitutions) from any of the CDR sequences of Table 14. In some embodiments, the antibody molecule to BCMA comprises a heavy chain variable domain sequence chosen from any of the amino acid sequences of Table 14, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions)).

Alternatively, or in combination with the heavy chain to BCMA disclosed herein, the antibody molecule to BCMA comprises one, two, or three CDRs from any of the light chain variable domain sequences of Table 14, or a closely related CDR, e.g., CDRs which have at least one amino acid alteration, but not more than two, three or four alterations (e.g., substitutions, deletions, or insertions, e.g., conservative substitutions) from any of the CDR sequences of Table 14. In some embodiments, the antibody molecule to BCMA comprises a light chain variable domain sequence chosen from any of the amino acid sequences of Table 14, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions)).

TABLE 14

Amino acid sequences of exemplary variable regions of anti-BCMA antibodies.

| SEQ ID NO | Description | Sequence |
|---|---|---|
| 3439] | 83A10 VH | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVLGWFDYWGQGTLVTVSS |
| 3440 | 83A10 VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGYPPDFTFGQGTKVEIK |
| 3441 | 17A5 VH | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVAPYFAPFDYWGQGTLVTVSS |
| 3442 | 17A5 VL | EIVLTQSPGTLSLSPGERATLSCRASQSVSSSYLAWYQQKPGQAPRLLIYGASSRATGIPDRFSGSGSGTDFTLTISRLEPEDFAVYYCQQYGNPPLYTFGQGTKVEIK |
| 3443 | 13A4 VH | EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARNGYLGDYWGQGTLVTVSS |
| 3444 | 13A4 VL | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQAMQIPTFGQGTKVEIK |
| 3445 | J22.9-xi VH | QVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSS |
| 3446 | J22.9-xi VL | DIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELKR |
| 3447 | 2A1 VH | EVQLVESGGGLVKPGGSLRLSCAASGFTFGDYALSWFRQAPGKGLEWVGVSRSKAYGGTTDYAASVKGRFTISRDDSKSTAYLQMNSLKTEDTAVYYCASSGYSSGWTPFDYWGQGTLVTVSS |
| 3448 | 2A1 VL | QSVLTQPPSASGTPGQRVTISCSGSSSNIGSNTVNWYQQLPGTAPKLLIFNYHQRPSGVPDRFSGSKSGSSASLAISGLQSEDEADYYCAAWDDSLNGWVFGGGTKLTVLG |

CDR-Grafted Scaffolds

In embodiments, the antibody molecule is a CDR-grafted scaffold domain. In embodiments, the scaffold domain is based on a fibronectin domain, e.g., fibronectin type III domain. The overall fold of the fibronectin type III (Fn3) domain is closely related to that of the smallest functional antibody fragment, the variable domain of the antibody heavy chain. There are three loops at the end of Fn3; the positions of BC, DE and FG loops approximately correspond to those of CDR1, 2 and 3 of the VH domain of an antibody. Fn3 does not have disulfide bonds; and therefore Fn3 is stable under reducing conditions, unlike antibodies and their fragments (see, e.g., WO 98/56915; WO 01/64942; WO 00/34784). An Fn3 domain can be modified (e.g., using CDRs or hypervariable loops described herein) or varied, e.g., to select domains that bind to an antigen/marker/cell described herein.

In embodiments, a scaffold domain, e.g., a folded domain, is based on an antibody, e.g., a "minibody" scaffold created by deleting three beta strands from a heavy chain variable domain of a monoclonal antibody (see, e.g., Tramontano et al., 1994, J Mol. Recognit. 7:9; and Martin et al., 1994, EMBO J. 13:5303-5309). The "minibody" can be used to present two hypervariable loops. In embodiments, the scaffold domain is a V-like domain (see, e.g., Coia et al. WO 99/45110) or a domain derived from tendamistatin, which is a 74 residue, six-strand beta sheet sandwich held together by two disulfide bonds (see, e.g., McConnell and Hoess, 1995, J Mol. Biol. 250:460). For example, the loops of tendamistatin can be modified (e.g., using CDRs or hypervariable loops) or varied, e.g., to select domains that bind to a marker/antigen/cell described herein. Another exemplary scaffold domain is a beta-sandwich structure derived from the extracellular domain of CTLA-4 (see, e.g., WO 00/60070).

Other exemplary scaffold domains include but are not limited to T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin, and heat shock proteins; and intracellular signaling domains (such as SH2 and SH3 domains). See, e.g., US 20040009530 and U.S. Pat. No. 7,501,121, incorporated herein by reference.

In embodiments, a scaffold domain is evaluated and chosen, e.g., by one or more of the following criteria: (1) amino acid sequence, (2) sequences of several homologous domains, (3) 3-dimensional structure, and/or (4) stability data over a range of pH, temperature, salinity, organic solvent, oxidant concentration. In embodiments, the scaffold domain is a small, stable protein domain, e.g., a protein of less than 100, 70, 50, 40 or 30 amino acids. The domain may include one or more disulfide bonds or may chelate a metal, e.g., zinc.

Antibody Based Fusions

A variety of formats can be generated which contain additional binding entities attached to the N or C terminus of antibodies. These fusions with single chain or disulfide stabilized Fvs or Fabs result in the generation of tetravalent molecules with bivalent binding specificity for each antigen. Combinations of scFvs and scFabs with IgGs enable the production of molecules which can recognize three or more different antigens.

Antibody Fab Fusion

Antibody-Fab fusions are bispecific antibodies comprising a traditional antibody to a first target and a Fab to a second target fused to the C terminus of the antibody heavy chain. Commonly the antibody and the Fab will have a common light chain. Antibody fusions can be produced by (1) engineering the DNA sequence of the target fusion, and (2) transfecting the target DNA into a suitable host cell to express the fusion protein. It seems like the antibody-scFv fusion may be linked by a (Gly)-Ser linker between the C-terminus of the CH3 domain and the N-terminus of the scFv, as described by Coloma, J. et al. (1997) *Nature Biotech* 15:159.

Antibody-scFv Fusion

Antibody-scFv Fusions are bispecific antibodies comprising a traditional antibody and a scFv of unique specificity fused to the C terminus of the antibody heavy chain. The scFv can be fused to the C terminus through the Heavy Chain of the scFv either directly or through a linker peptide. Antibody fusions can be produced by (1) engineering the DNA sequence of the target fusion, and (2) transfecting the target DNA into a suitable host cell to express the fusion protein. It seems like the antibody-scFv fusion may be linked by a (Gly)-Ser linker between the C-terminus of the CH3 domain and the N-terminus of the scFv, as described by Coloma, J. et al. (1997) *Nature Biotech* 15:159.

Variable Domain Immunoglobulin DVD

A related format is the dual variable domain immunoglobulin (DVD), which are composed of VH and VL domains of a second specificity place upon the N termini of the V domains by shorter linker sequences.

Other exemplary multispecific antibody formats include, e.g., those described in the following US20160114057A1, US20130243775A1, US20140051833, US20130022601, US20150017187A1, US20120201746A1, US20150133638A1, US20130266568A1, US20160145340A1, WO2015127158A1, US20150203591A1, US20140322221A1, US20130303396A1, US20110293613, US20130017200A1, US20160102135A1, WO2015197598A2, WO2015197582A1, U.S. Pat. No. 9,359,437, US20150018529, WO2016115274A1, WO2016087416A1, US20080069820A1, U.S. Pat. Nos. 9,145,588B, 7,919,257, and US20150232560A1 Exemplary multispecific molecules utilizing a full antibody-Fab/scFab format include those described in the following, U.S. Pat. No. 9,382,323B2, US20140072581A1, US20140308285A1, US20130165638A1, US20130267686A1, US20140377269A1, U.S. Pat. No. 7,741,446B2, and WO1995009917A1. Exemplary multispecific molecules utilizing a domain exchange format include those described in the following, US20150315296A1, WO2016087650A1, US20160075785A1, WO2016016299A1, US20160130347A1, US20150166670, U.S. Pat. No. 8,703,132B2, US20100316645, U.S. Pat. No. 8,227,577B2, US20130078249.

Fc-Containing Entities (Mini-Antibodies)

Fc-containing entities, also known as mini-antibodies, can be generated by fusing scFv to the C-termini of constant heavy region domain 3 (CH3-scFv) and/or to the hinge region (scFv-hinge-Fc) of an antibody with a different specificity. Trivalent entities can also be made which have disulfide stabilized variable domains (without peptide linker) fused to the C-terminus of CH3 domains of IgGs.

Fc-Containing Multispecific Molecules

In some embodiments, the multispecific molecules disclosed herein includes an immunoglobulin constant region (e.g., an Fc region). Exemplary Fc regions can be chosen from the heavy chain constant regions of IgG1, IgG2, IgG3 or IgG4; more particularly, the heavy chain constant region of human IgG1, IgG2, IgG3, or IgG4.

In some embodiments, the immunoglobulin chain constant region (e.g., the Fc region) is altered, e.g., mutated, to increase or decrease one or more of: Fc receptor binding, antibody glycosylation, the number of cysteine residues, effector cell function, or complement function.

In other embodiments, an interface of a first and second immunoglobulin chain constant regions (e.g., a first and a second Fc region) is altered, e.g., mutated, to increase or decrease dimerization, e.g., relative to a non-engineered interface, e.g., a naturally-occurring interface. For example, dimerization of the immunoglobulin chain constant region (e.g., the Fc region) can be enhanced by providing an Fc interface of a first and a second Fc region with one or more of: a paired protuberance-cavity ("knob-in-a hole"), an electrostatic interaction, or a strand-exchange, such that a greater ratio of heteromultimer to homomultimer forms, e.g., relative to a non-engineered interface.

In some embodiments, the multispecific molecules include a paired amino acid substitution at a position chosen from one or more of 347, 349, 350, 351, 366, 368, 370, 392, 394, 395, 397, 398, 399, 405, 407, or 409, e.g., of the Fc region of human IgG1 For example, the immunoglobulin chain constant region (e.g., Fc region) can include a paired an amino acid substitution chosen from: T366S, L368A, or Y407V (e.g., corresponding to a cavity or hole), and T366W (e.g., corresponding to a protuberance or knob).

In other embodiments, the multifunctional molecule includes a half-life extender, e.g., a human serum albumin or an antibody molecule to human serum albumin.

Heterodimerized Antibody Molecules & Methods of Making

Various methods of producing multispecific antibodies have been disclosed to address the problem of incorrect heavy chain pairing. Exemplary methods are described below. Exemplary multispecific antibody formats and methods of making said multispecific antibodies are also disclosed in e.g., Speiss et al. Molecular Immunology 67 (2015) 95-106; and Klein et al mAbs 4:6, 653-663; November/December 2012; the entire contents of each of which are incorporated by reference herein.

Heterodimerized bispecific antibodies are based on the natural IgG structure, wherein the two binding arms recognize different antigens. IgG derived formats that enable defined monovalent (and simultaneous) antigen binding are generated by forced heavy chain heterodimerization, combined with technologies that minimize light chain mispairing (e.g., common light chain). Forced heavy chain heterodimerization can be obtained using, e.g., knob-in-hole OR strand exchange engineered domains (SEED).

Knob-in-Hole

Knob-in-Hole as described in U.S. Pat. Nos. 5,731,116, 7,476,724 and Ridgway, J. et al. (1996) *Prot. Engineering* 9(7): 617-621, broadly involves: (1) mutating the CH3 domain of one or both antibodies to promote heterodimerization; and (2) combining the mutated antibodies under conditions that promote heterodimerization. "Knobs" or "protuberances" are typically created by replacing a small amino acid in a parental antibody with a larger amino acid (e.g., T366Y or T366W); "Holes" or "cavities" are created by replacing a larger residue in a parental antibody with a smaller amino acid (e.g., Y407T, T366S, L368A and/or Y407V).

For bispecific antibodies including an Fc domain, introduction of specific mutations into the constant region of the heavy chains to promote the correct heterodimerization of the Fc portion can be utilized. Several such techniques are reviewed in Klein et al. (mAbs (2012) 4:6, 1-11), the contents of which are incorporated herein by reference in their entirety. These techniques include the "knobs-into-holes" (KiH) approach which involves the introduction of a bulky residue into one of the CH3 domains of one of the antibody heavy chains. This bulky residue fits into a complementary "hole" in the other CH3 domain of the paired heavy chain so as to promote correct pairing of heavy chains (see e.g., U.S. Pat. No. 7,642,228).

Exemplary KiH mutations include S354C, T366W in the "knob" heavy chain and Y349C, T366S, L368A, Y407V in the "hole" heavy chain. Other exemplary KiH mutations are provided in Table 4, with additional optional stabilizing Fc cysteine mutations.

TABLE 4

Exemplary Fc KiH mutations and optional Cysteine mutations

| Position | Knob Mutation | Hole Mutation |
|---|---|---|
| T366 | T366W | T366S |
| L368 | — | L368A |
| Y407 | — | Y407V |

Additional Cysteine Mutations to form a stabilizing disulfide bridge

| Position | Knob CH3 | Hole CH3 |
|---|---|---|
| S354 | S354C | — |
| Y349 | — | Y349C |

Other Fc mutations are provided by Igawa and Tsunoda who identified 3 negatively charged residues in the CH3 domain of one chain that pair with three positively charged residues in the CH3 domain of the other chain. These specific charged residue pairs are: E356-K439, E357-K370, D399-K409 and vice versa. By introducing at least two of the following three mutations in chain A: E356K, E357K and D399K, as well as K370E, K409D, K439E in chain B, alone or in combination with newly identified disulfide bridges, they were able to favor very efficient heterodimerization while suppressing homodimerization at the same time (Martens T et al. A novel one-armed antic-Met antibody inhibits glioblastoma growth in vivo. Clin Cancer Res 2006; 12:6144-52; PMID: 17062691). Xencor defined 41 variant pairs based on combining structural calculations and sequence information that were subsequently screened for maximal heterodimerization, defining the combination of S364H, F405A (HA) on chain A and Y349T, T394F on chain B (TF) (Moore G L et al. A novel bispecific antibody format enables simultaneous bivalent and monovalent co-engagement of distinct target antigens. MAbs 2011; 3:546-57; PMID: 22123055).

Other exemplary Fc mutations to promote heterodimerization of multispecific antibodies include those described in the following references, the contents of each of which is incorporated by reference herein, WO2016071377A1, US20140079689A1, US20160194389A1, US20160257763, WO2016071376A2, WO2015107026A1, WO2015107025A1, WO2015107015A1, US20150353636A1, US20140199294A1, U.S. Pat. No. 7,750,128B2, US20160229915A1, US20150344570A1, U.S. Pat. No. 8,003,774A1, US20150337049A1, US20150175707A1, US20140242075A1, US20130195849A1, US20120149876A1, US20140200331A1, U.S. Pat. No. 9,309,311B2, U.S. Pat. No. 8,586,713, US20140037621A1, US20130178605A1, US20140363426A1, US20140051835A1 and US20110054151A1.

Stabilizing cysteine mutations have also been used in combination with KiH and other Fc heterodimerization promoting variants, see e.g., U.S. Pat. No. 7,183,076. Other exemplary cysteine modifications include, e.g., those disclosed in US20140348839A1, U.S. Pat. No. 7,855,275B2, and U.S. Pat. No. 9,000,130B2.

Strand Exchange Engineered Domains (SEED)

Heterodimeric Fc platform that support the design of bispecific and asymmetric fusion proteins by devising strand-exchange engineered domain (SEED) C(H)3 heterodimers are known. These derivatives of human IgG and IgA C(H)3 domains create complementary human SEED C(H)3 heterodimers that are composed of alternating segments of human IgA and IgG C(H)3 sequences. The resulting pair of SEED C(H)3 domains preferentially associates to form heterodimers when expressed in mammalian cells. SEEDbody (Sb) fusion proteins consist of [IgG1 hinge]-C (H)2-[SEED C(H)3], that may be genetically linked to one or more fusion partners (see e.g., Davis J H et al. SEEDbodies: fusion proteins based on strand exchange engineered domain (SEED) CH3 heterodimers in an Fc analogue platform for asymmetric binders or immunofusions and bispecific antibodies. Protein Eng Des Sel 2010; 23:195-202; PMID: 20299542 and U.S. Pat. No. 8,871,912. The contents of each of which are incorporated by reference herein).

Duobody

"Duobody" technology to produce bispecific antibodies with correct heavy chain pairing are known. The DuoBody technology involves three basic steps to generate stable bispecific human IgG1 antibodies in a post-production exchange reaction. In a first step, two IgG1s, each containing single matched mutations in the third constant (CH3) domain, are produced separately using standard mammalian recombinant cell lines. Subsequently, these IgG1 antibodies are purified according to standard processes for recovery and purification. After production and purification (post-production), the two antibodies are recombined under tailored laboratory conditions resulting in a bispecific antibody product with a very high yield (typically >95%) (see e.g., Labrijn et al, PNAS 2013; 110(13):5145-5150 and Labrijn et al. Nature Protocols 2014; 9(10):2450-63, the contents of each of which are incorporated by reference herein).

Electrostatic Interactions

Methods of making multispecific antibodies using CH3 amino acid changes with charged amino acids such that homodimer formation is electrostatically unfavorable are disclosed. EP1870459 and WO 2009089004 describe other strategies for favoring heterodimer formation upon co-expression of different antibody domains in a host cell. In these methods, one or more residues that make up the heavy chain constant domain 3 (CH3), CH3-CH3 interfaces in both CH3 domains are replaced with a charged amino acid such that homodimer formation is electrostatically unfavorable and heterodimerization is electrostatically favorable. Additional methods of making multispecific molecules using electrostatic interactions are described in the following references, the contents of each of which is incorporated by reference herein, include US20100015133, U.S. Pat. No. 8,592, 562B2, U.S. Pat. No. 9,200,060B2, US20140154254A1, and U.S. Pat. No. 9,358,286A1.

Common Light Chain

Light chain mispairing needs to be avoided to generate homogenous preparations of bispecific IgGs. One way to achieve this is through the use of the common light chain principle, i.e. combining two binders that share one light chain but still have separate specificities. An exemplary method of enhancing the formation of a desired bispecific antibody from a mixture of monomers is by providing a common variable light chain to interact with each of the heteromeric variable heavy chain regions of the bispecific antibody. Compositions and methods of producing bispecific antibodies with a common light chain as disclosed in, e.g., U.S. Pat. No. 7,183,076B2, US20110177073A1, EP2847231A1, WO2016079081A1, and EP3055329A1, the contents of each of which is incorporated by reference herein.

CrossMab

Another option to reduce light chain mispairing is the CrossMab technology which avoids non-specific L chain mispairing by exchanging CH1 and CL domains in the Fab of one half of the bispecific antibody. Such crossover variants retain binding specificity and affinity, but make the two arms so different that L chain mispairing is prevented. The CrossMab technology (as reviewed in Klein et al. Supra) involves domain swapping between heavy and light chains so as to promote the formation of the correct pairings. Briefly, to construct a bispecific IgG-like CrossMab antibody that could bind to two antigens by using two distinct light chain-heavy chain pairs, a two-step modification process is applied. First, a dimerization interface is engineered into the C-terminus of each heavy chain using a heterodimerization approach, e.g., Knob-into-hole (KiH) technology, to ensure that only a heterodimer of two distinct heavy chains from one antibody (e.g., Antibody A) and a second antibody (e.g., Antibody B) is efficiently formed. Next, the constant heavy 1 (CH1) and constant light (CL) domains of one antibody are exchanged (Antibody A), keeping the variable heavy (VH) and variable light (VL) domains consistent. The exchange of the CH1 and CL domains ensured that the modified antibody (Antibody A) light chain would only efficiently dimerize with the modified antibody (antibody A) heavy chain, while the unmodified antibody (Antibody B) light chain would only efficiently dimerize with the unmodified antibody (Antibody B) heavy chain; and thus only the desired bispecific CrossMab would be efficiently formed (see e.g., Cain, C. SciBX 4(28); doi:10.1038/scibx.2011.783, the contents of which are incorporated by reference herein).

Common Heavy Chain

An exemplary method of enhancing the formation of a desired bispecific antibody from a mixture of monomers is by providing a common variable heavy chain to interact with each of the heteromeric variable light chain regions of the bispecific antibody. Compositions and methods of producing bispecific antibodies with a common heavy chain are disclosed in, e.g., US20120184716, US20130317200, and US20160264685A1, the contents of each of which is incorporated by reference herein.

Amino Acid Modifications

Alternative compositions and methods of producing multispecific antibodies with correct light chain pairing include various amino acid modifications. For example, Zymeworks describes heterodimers with one or more amino acid modifications in the CH1 and/or CL domains, one or more amino acid modifications in the VH and/or VL domains, or a combination thereof, which are part of the interface between the light chain and heavy chain and create preferential pairing between each heavy chain and a desired light chain such that when the two heavy chains and two light chains of the heterodimer pair are co-expressed in a cell, the heavy chain of the first heterodimer preferentially pairs with one of the light chains rather than the other (see e.g., WO2015181805). Other exemplary methods are described in WO2016026943 (Argen-X), US20150211001, US20140072581A1, US20160039947A1, and US20150368352.

Lambda/Kappa Formats

Multispecific molecules (e.g., multispecific antibody molecules) that include the lambda light chain polypeptide and a kappa light chain polypeptides, can be used to allow for heterodimerization. Methods for generating bispecific antibody molecules comprising the lambda light chain polypeptide and a kappa light chain polypeptides are disclosed in PCT/US17/53053 filed on Sep. 22, 2017 and designated publication number WO 2018/057955, incorporated herein by reference in its entirety.

In embodiments, the multispecific molecule includes a multispecific antibody molecule, e.g., an antibody molecule comprising two binding specificities, e.g., a bispecific antibody molecule. The multispecific antibody molecule includes:

a lambda light chain polypeptide 1 (LLCP1) specific for a first epitope;

a heavy chain polypeptide 1 (HCP1) specific for the first epitope;

a kappa light chain polypeptide 2 (KLCP2) specific for a second epitope; and a heavy chain polypeptide 2 (HCP2) specific for the second epitope.

"Lambda light chain polypeptide 1 (LLCP1)", as that term is used herein, refers to a polypeptide comprising sufficient light chain (LC) sequence, such that when combined with a cognate heavy chain variable region, can mediate specific binding to its epitope and complex with an HCP1. In an embodiment it comprises all or a fragment of a CH1 region. In an embodiment, an LLCP1 comprises LC-CDR1, LC-CDR2, LC-CDR3, FR1, FR2, FR3, FR4, and CH1, or sufficient sequence therefrom to mediate specific binding of its epitope and complex with an HCP1. LLCP1, together with its HCP1, provide specificity for a first epitope (while KLCP2, together with its HCP2, provide specificity for a second epitope). As described elsewhere herein, LLCP1 has a higher affinity for HCP1 than for HCP2.

"Kappa light chain polypeptide 2 (KLCP2)", as that term is used herein, refers to a polypeptide comprising sufficient light chain (LC) sequence, such that when combined with a cognate heavy chain variable region, can mediate specific binding to its epitope and complex with an HCP2. In some embodiments, it comprises all or a fragment of a CH1 region. In an embodiment, a KLCP2 comprises LC-CDR1, LC-CDR2, LC-CDR3, FR1, FR2, FR3, FR4, and CH1, or sufficient sequence therefrom to mediate specific binding of its epitope and complex with an HCP2. KLCP2, together with its HCP2, provide specificity for a second epitope (while LLCP1, together with its HCP1, provide specificity for a first epitope).

"Heavy chain polypeptide 1 (HCP1)", as that term is used herein, refers to a polypeptide comprising sufficient heavy chain (HC) sequence, e.g., HC variable region sequence, such that when combined with a cognate LLCP1, can mediate specific binding to its epitope and complex with an HCP1. In some embodiments, it comprises all or a fragment of a CH1 region. In an embodiment, it comprises all or a fragment of a CH2 and/or CH3 region. In an embodiment an HCP1 comprises HC-CDR1, HC-CDR2, HC-CDR3, FR1, FR2, FR3, FR4, CH1, CH2, and CH3, or sufficient sequence therefrom to: (i) mediate specific binding of its epitope and complex with an LLCP1, (ii) to complex preferentially, as described herein to LLCP1 as opposed to KLCP2; and (iii)

to complex preferentially, as described herein, to an HCP2, as opposed to another molecule of HCP 1. HCP 1, together with its LLCP1, provide specificity for a first epitope (while KLCP2, together with its HCP2, provide specificity for a second epitope).

"Heavy chain polypeptide 2 (HCP2)", as that term is used herein, refers to a polypeptide comprising sufficient heavy chain (HC) sequence, e.g., HC variable region sequence, such that when combined with a cognate LLCP1, can mediate specific binding to its epitope and complex with an HCP1. In some embodiments, it comprises all or a fragment of a CH1 region. In some embodiments, it comprises all or a fragment of a CH2 and/or CH3 region. In an embodiment an HCP1 comprises HC-CDR1, HC-CDR2, HC-CDR3, FR1, FR2, FR3, FR4, CH1, CH2, and CH3, or sufficient sequence therefrom to: (i) mediate specific binding of its epitope and complex with an KLCP2, (ii) to complex preferentially, as described herein to KLCP2 as opposed to LLCP1; and (iii) to complex preferentially, as described herein, to an HCP1, as opposed to another molecule of HCP2. HCP2, together with its KLCP2, provide specificity for a second epitope (while LLCP1, together with its HCP1, provide specificity for a first epitope).

In some embodiments of the multispecific antibody molecule disclosed herein:
  LLCP1 has a higher affinity for HCP1 than for HCP2; and/or
  KLCP2 has a higher affinity for HCP2 than for HCP1.

In embodiments, the affinity of LLCP1 for HCP1 is sufficiently greater than its affinity for HCP2, such that under preselected conditions, e.g., in aqueous buffer, e.g., at pH 7, in saline, e.g., at pH 7, or under physiological conditions, at least 75, 80, 90, 95, 98, 99, 99.5, or 99.9% of the multispecific antibody molecule molecules have a LLCP1 complexed, or interfaced with, a HCP1.

In some embodiments of the multispecific antibody molecule disclosed herein:
  the HCP 1 has a greater affinity for HCP2, than for a second molecule of HCP 1; and/or
  the HCP2 has a greater affinity for HCP1, than for a second molecule of HCP2.

In embodiments, the affinity of HCP1 for HCP2 is sufficiently greater than its affinity for a second molecule of HCP1, such that under preselected conditions, e.g., in aqueous buffer, e.g., at pH 7, in saline, e.g., at pH 7, or under physiological conditions, at least 75%, 80, 90, 95, 98, 99 99.5 or 99.9% of the multispecific antibody molecule molecules have a HCP1 complexed, or interfaced with, a HCP2.

In another aspect, disclosed herein is a method for making, or producing, a multispecific antibody molecule. The method includes:
  (i) providing a first heavy chain polypeptide (e.g., a heavy chain polypeptide comprising one, two, three or all of a first heavy chain variable region (first VH), a first CH1, a first heavy chain constant region (e.g., a first CH2, a first CH3, or both));
  (ii) providing a second heavy chain polypeptide (e.g., a heavy chain polypeptide comprising one, two, three or all of a second heavy chain variable region (second VH), a second CH1, a second heavy chain constant region (e.g., a second CH2, a second CH3, or both));
  (iii) providing a lambda chain polypeptide (e.g., a lambda light variable region (VLX), a lambda light constant chain (VLX), or both) that preferentially associates with the first heavy chain polypeptide (e.g., the first VH); and
  (iv) providing a kappa chain polypeptide (e.g., a lambda light variable region (VLK), a lambda light constant chain (VLx), or both) that preferentially associates with the second heavy chain polypeptide (e.g., the second VH),
  under conditions where (i)-(iv) associate.

In embodiments, the first and second heavy chain polypeptides form an Fc interface that enhances heterodimerization.

In embodiments, (i)-(iv) (e.g., nucleic acid encoding (i)-(iv)) are introduced in a single cell, e.g., a single mammalian cell, e.g., a CHO cell. In embodiments, (i)-(iv) are expressed in the cell.

In embodiments, (i)-(iv) (e.g., nucleic acid encoding (i)-(iv)) are introduced in different cells, e.g., different mammalian cells, e.g., two or more CHO cell. In embodiments, (i)-(iv) are expressed in the cells.

In embodiments, the method further comprises purifying a cell-expressed antibody molecule, e.g., using a lambda— and/or—kappa-specific purification, e.g., affinity chromatography.

In embodiments, the method further comprises evaluating the cell-expressed multispecific antibody molecule. For example, the purified cell-expressed multispecific antibody molecule can be analyzed by techniques known in the art, include mass spectrometry. In one embodiment, the purified cell-expressed antibody molecule is cleaved, e.g., digested with papain to yield the Fab moieties and evaluated using mass spectrometry.

In embodiments, the method produces correctly paired kappa/lambda multispecific, e.g., bispecific, antibody molecules in a high yield, e.g., at least 75%, 80, 90, 95, 98, 99 99.5 or 99.9%.

In other embodiments, the multispecific, e.g., a bispecific, antibody molecule that includes:
  (i) a first heavy chain polypeptide (HCP1) (e.g., a heavy chain polypeptide comprising one, two, three or all of a first heavy chain variable region (first VH), a first CH1, a first heavy chain constant region (e.g., a first CH2, a first CH3, or both)), e.g., wherein the HCP1 binds to a first epitope;
  (ii) a second heavy chain polypeptide (HCP2) (e.g., a heavy chain polypeptide comprising one, two, three or all of a second heavy chain variable region (second VH), a second CH1, a second heavy chain constant region (e.g., a second CH2, a second CH3, or both)), e.g., wherein the HCP2 binds to a second epitope;
  (iii) a lambda light chain polypeptide (LLCP1) (e.g., a lambda light variable region (VL1), a lambda light constant chain (VL1), or both) that preferentially associates with the first heavy chain polypeptide (e.g., the first VH), e.g., wherein the LLCP1 binds to a first epitope; and
  (iv) a kappa light chain polypeptide (KLCP2) (e.g., a lambda light variable region (VLk), a lambda light constant chain (VLk), or both) that preferentially associates with the second heavy chain polypeptide (e.g., the second VH), e.g., wherein the KLCP2 binds to a second epitope.

In embodiments, the first and second heavy chain polypeptides form an Fc interface that enhances heterodimerization. In embodiments, the multispecific antibody molecule has a first binding specificity that includes a hybrid VL1-CL1 heterodimerized to a first heavy chain variable region connected to the Fc constant, CH2-CH3 domain (having a knob modification) and a second binding specificity that includes a hybrid VLk-CLk heterodimerized to a second heavy chain variable region connected to the Fc constant, CH2-CH3 domain (having a hole modification).

Cytokine Molecules

Cytokines are generally polypeptides that influence cellular activity, for example, through signal transduction pathways. Accordingly, a cytokine of the multispecific or multifunctional polypeptide is useful and can be associated with receptor-mediated signaling that transmits a signal from outside the cell membrane to modulate a response within the cell. Cytokines are proteinaceous signaling compounds that are mediators of the immune response. They control many different cellular functions including proliferation, differentiation and cell survival/apoptosis; cytokines are also involved in several pathophysiological processes including viral infections and autoimmune diseases. Cytokines are synthesized under various stimuli by a variety of cells of both the innate (monocytes, macrophages, dendritic cells) and adaptive (T- and B-cells) immune systems. Cytokines can be classified into two groups: pro- and anti-inflammatory. Pro-inflammatory cytokines, including IFNγ, IL-1, IL-6 and TNF-alpha, are predominantly derived from the innate immune cells and Th1 cells. Anti-inflammatory cytokines, including IL-10, IL-4, IL-13 and IL-5, are synthesized from Th2 immune cells.

The present disclosure provides, inter alia, multispecific (e.g., bi-, tri-, quad-specific) or multifunctional molecules, that include, e.g., are engineered to contain, one or more cytokine molecules, e.g., immunomodulatory (e.g., proinflammatory) cytokines and variants, e.g., functional variants, thereof. Accordingly, in some embodiments, the cytokine molecule is an interleukin or a variant, e.g., a functional variant thereof. In some embodiments the interleukin is a proinflammatory interleukin. In some embodiments the interleukin is chosen from interleukin-2 (IL-2), interleukin-12 (IL-12), interleukin-15 (IL-15), interleukin-18 (IL-18), interleukin-21 (IL-21), interleukin-7 (IL-7), or interferon gamma. In some embodiments, the cytokine molecule is a proinflammatory cytokine.

In certain embodiments, the cytokine is a single chain cytokine. In certain embodiments, the cytokine is a multi-chain cytokine (e.g., the cytokine comprises 2 or more (e.g., 2) polypeptide chains. An exemplary multichain cytokine is IL-12.

Examples of useful cytokines include, but are not limited to, GM-CSF, IL-1a, IL-1β, IL-2, IL-3, IL-4, IL-5, IL-6, IL-7, IL-8, IL-10, IL-12, IL-21, IFN-α, IFN-β, IFN-γ, MIP-1α, MIP-1β, TGF-β, TNF-α, and TNFβ. In one embodiment the cytokine of the multispecific or multifunctional polypeptide is a cytokine selected from the group of GM-CSF, IL-2, IL-7, IL-8, IL-10, IL-12, IL-15, IL-21, IFN-α, IFN-γ, MIP-1α, MIP-1β and TGF-β. In one embodiment the cytokine of the i the multispecific or multifunctional polypeptide is a cytokine selected from the group of IL-2, IL-7, IL-10, IL-12, IL-15, IFN-α, and IFN-γ. In certain embodiments the cytokine is mutated to remove N- and/or O-glycosylation sites. Elimination of glycosylation increases homogeneity of the product obtainable in recombinant production.

In one embodiment, the cytokine of the multispecific or multifunctional polypeptide is IL-2. In a specific embodiment, the IL-2 cytokine can elicit one or more of the cellular responses selected from the group consisting of: proliferation in an activated T lymphocyte cell, differentiation in an activated T lymphocyte cell, cytotoxic T cell (CTL) activity, proliferation in an activated B cell, differentiation in an activated B cell, proliferation in a natural killer (NK) cell, differentiation in a NK cell, cytokine secretion by an activated T cell or an NK cell, and NK/lymphocyte activated killer (LAK) antitumor cytotoxicity. In another particular embodiment the IL-2 cytokine is a mutant IL-2 cytokine having reduced binding affinity to the .alpha.-subunit of the IL-2 receptor. Together with the .beta.- and .gamma.-subunits (also known as CD122 and CD132, respectively), the .alpha.-subunit (also known as CD25) forms the heterotrimeric high-affinity IL-2 receptor, while the dimeric receptor consisting only of the β- and γ-subunits is termed the intermediate-affinity IL-2 receptor. As described in PCT patent application number PCT/EP2012/051991, which is incorporated herein by reference in its entirety, a mutant IL-2 polypeptide with reduced binding to the .alpha.-subunit of the IL-2 receptor has a reduced ability to induce IL-2 signaling in regulatory T cells, induces less activation-induced cell death (AICD) in T cells, and has a reduced toxicity profile in vivo, compared to a wild-type IL-2 polypeptide. The use of such an cytokine with reduced toxicity is particularly advantageous in a multispecific or multifunctional polypeptide according to the invention, having a long serum half-life due to the presence of an Fc domain. In one embodiment, the mutant IL-2 cytokine of the multispecific or multifunctional polypeptide according to the invention comprises at least one amino acid mutation that reduces or abolishes the affinity of the mutant IL-2 cytokine to the .alpha.-subunit of the IL-2 receptor (CD25) but preserves the affinity of the mutant IL-2 cytokine to the intermediate-affinity IL-2 receptor (consisting of the β and γ subunits of the IL-2 receptor), compared to the non-mutated IL-2 cytokine. In one embodiment the one or more amino acid mutations are amino acid substitutions. In a specific embodiment, the mutant IL-2 cytokine comprises one, two or three amino acid substitutions at one, two or three position(s) selected from the positions corresponding to residue 42, 45, and 72 of human IL-2. In a more specific embodiment, the mutant IL-2 cytokine comprises three amino acid substitutions at the positions corresponding to residue 42, 45 and 72 of human IL-2. In an even more specific embodiment, the mutant IL-2 cytokine is human IL-2 comprising the amino acid substitutions F42A, Y45A and L72G. In one embodiment the mutant IL-2 cytokine additionally comprises an amino acid mutation at a position corresponding to position 3 of human IL-2, which eliminates the 0-glycosylation site of IL-2. Particularly, said additional amino acid mutation is an amino acid substitution replacing a threonine residue by an alanine residue. A particular mutant IL-2 cytokine useful in the invention comprises four amino acid substitutions at positions corresponding to residues 3, 42, 45 and 72 of human IL-2. Specific amino acid substitutions are T3A, F42A, Y45A and L72G. As demonstrated in PCT patent application number PCT/EP2012/051991 and in the appended Examples, said quadruple mutant IL-2 polypeptide (IL-2 qm) exhibits no detectable binding to CD25, reduced ability to induce apoptosis in T cells, reduced ability to induce IL-2 signaling in T.sub.reg cells, and a reduced toxicity profile in vivo. However, it retains ability to activate IL-2 signaling in effector cells, to induce proliferation of effector cells, and to generate IFN-γ as a secondary cytokine by NK cells.

The IL-2 or mutant IL-2 cytokine according to any of the above embodiments may comprise additional mutations that provide further advantages such as increased expression or stability. For example, the cysteine at position 125 may be replaced with a neutral amino acid such as alanine, to avoid the formation of disulfide-bridged IL-2 dimers. Thus, in certain embodiments the IL-2 or mutant IL-2 cytokine of the multispecific or multifunctional polypeptide according to the invention comprises an additional amino acid mutation at a position corresponding to residue 125 of human IL-2. In one embodiment said additional amino acid mutation is the amino acid substitution C125A.

In a specific embodiment the IL-2 cytokine of the multispecific or multifunctional polypeptide comprises the polypeptide sequence of SEQ ID NO: 2270 [APTSSSTKKTQLQLEHLLLDLQMILNGINN YKNPKLTRMLTFKFYMPK-KATELKHLQCLEEELKPLEEVLNLAQSKNFHL RPRDLISNINVIVLELKGSETTFMCEYADETATIVE-FLNRWITFAQSIISTLT].

In another specific embodiment the IL-2 cytokine of the multispecific or multifunctional polypeptide comprises the polypeptide sequence of SEQ ID NO: 2280 [APASSSTKKT QLQLEHLLLD LQMILNGINN YKNPKLTRMLTAK-FAMPKKATELKHLQCLE EELKPLEEVLN-GAQSKNFHL RPRDLISNIN VIVLELKGSETTFMC-EYADETATIVEFLNRWITFAQSIISTLT].

In another embodiment the cytokine of the multispecific or multifunctional polypeptide is IL-12. In a specific embodiment said IL-12 cytokine is a single chain IL-12 cytokine. In an even more specific embodiment the single chain IL-12 cytokine comprises the polypeptide sequence of SEQ ID NO: 2290 [IWELKKDVYVVELDWYPDAPGEMVVLTCDTPEED-GITWTLDQSSEVLGSGKTLTIQVK EFGDAGQYTCHKGGEVLSHSLLLLHKKEDGIW-STDILKDQKEPKNKTFLRCEAKNYSGR FTCWWLT-TISTDLTFSVKSSRGSSDPQGVTCGAATL-SAERVRGDNKEYEYSVECQEDSA CPAAEESLPIEVMVDAVHKLKYENYTSSFFIR-DIIKPDPPKNLQLKPLKNSRQVEVSWEY PDTW-STPHSYFSLTFCVQVQGKSKREKKDRVFTDKTSATVI-CRKNASISVRAQDRYYSS SWSEWASVPCSGGGGSGGGGSGGGGSRNLP-VATPDPGMFPCLHHSQNLLRAVSNMLQ KAR-QTLEFYPCTSEEIDHEDITKDKTSTVEACLPLELTK-NESCLNSRETSFITNGSCLASRK TSFMMALCLSSIYEDLKMYQVEFKTMNAKLL-MDPKRQIFLDQNMLAVIDELMQALNFN SETVPQKSSLEEPDFYKTKIKLCILLHAFRI-RAVTIDRVMSYLNAS]. In one embodiment, the IL-12 cytokine can elicit one or more of the cellular responses selected from the group consisting of: proliferation in a NK cell, differentiation in a NK cell, proliferation in a T cell, and differentiation in a T cell.

In another embodiment the cytokine of the multispecific or multifunctional polypeptide is IL-10. In a specific embodiment said IL-10 cytokine is a single chain IL-10 cytokine. In an even more specific embodiment the single chain IL-10 cytokine comprises the polypeptide sequence of SEQ ID NO: 2300 [SPGQGTQSEN-SCTHFPGNLPNMLRDLRDAFSRVKTFFQMKDQL-DNLLLKESLLEDFKG YLGCQALSEMI-QFYLEEVMPQAENQDPDIKAHVNSL-GENLKTLRLRLRRCHRFLPCENK SKAVEQVKNAFNKLQEKGIYKAMSEFDI-FINYIEAYMTMKIRNGGGGSGGGGSGGGGS GGGGSSPGQGTQSEN-SCTHFPGNLPNMLRDLRDAFSRVKTFFQMKDQLD-NLLLKESLLE DFKGYLGCQALSEMI-QFYLEEVMPQAENQDPDIKAHVNSL-GENLKTLRLRLRRCHRFLP CENK-SKAVEQVKNAFNKLQEKGIYKAMSEFDIFINYIEA-YMTMKIRN].

In another specific embodiment the IL-10 cytokine is a monomeric IL-10 cytokine. In a more specific embodiment the monomeric IL-10 cytokine comprises the polypeptide sequence of SEQ ID NO: 2310 [SPGQGTQSEN-SCTHFPGNLPNMLRDLRDAFSRVKTFFQMKDQ-LDNLLLKESLLEDFKG YLGCQALSEMI-QFYLEEVMPQAENQDPDIKAHVNSL-GENLKTLRLRLRRCHRFLPCENG GGSGGK-SKAVEQVKNAFNKLQEKGIYKAMSEFDIFINYIE-AYMTMKIRN]. In one embodiment, the IL-10 cytokine can elicit one or more of the cellular responses selected from the group consisting of: inhibition of cytokine secretion, inhibition of antigen presentation by antigen presenting cells, reduction of oxygen radical release, and inhibition of T cell proliferation. A multispecific or multifunctional polypeptide according to the invention wherein the cytokine is IL-10 is particularly useful for downregulation of inflammation, e.g. in the treatment of an inflammatory disorder.

In another embodiment, the cytokine of the multispecific or multifunctional polypeptide is IL-15. In a specific embodiment said IL-15 cytokine is a mutant IL-15 cytokine having reduced binding affinity to the α-subunit of the IL-15 receptor. Without wishing to be bound by theory, a mutant IL-15 polypeptide with reduced binding to the .alpha.-subunit of the IL-15 receptor has a reduced ability to bind to fibroblasts throughout the body, resulting in improved pharmacokinetics and toxicity profile, compared to a wild-type IL-15 polypeptide. The use of an cytokine with reduced toxicity, such as the described mutant IL-2 and mutant IL-15 effector moieties, is particularly advantageous in a multispecific or multifunctional polypeptide according to the invention, having a long serum half-life due to the presence of an Fc domain. In one embodiment the mutant IL-15 cytokine of the multispecific or multifunctional polypeptide according to the invention comprises at least one amino acid mutation that reduces or abolishes the affinity of the mutant IL-15 cytokine to the .alpha.-subunit of the IL-15 receptor but preserves the affinity of the mutant IL-15 cytokine to the intermediate-affinity IL-15/IL-2 receptor (consisting of the .beta.- and .gamma.-subunits of the IL-15/IL-2 receptor), compared to the non-mutated IL-15 cytokine. In one embodiment the amino acid mutation is an amino acid substitution. In a specific embodiment, the mutant IL-15 cytokine comprises an amino acid substitution at the position corresponding to residue 53 of human IL-15. In a more specific embodiment, the mutant IL-15 cytokine is human IL-15 comprising the amino acid substitution E53A. In one embodiment the mutant IL-15 cytokine additionally comprises an amino acid mutation at a position corresponding to position 79 of human IL-15, which eliminates the N glycosylation site of IL-15. Particularly, said additional amino acid mutation is an amino acid substitution replacing an asparagine residue by an alanine residue. In an even more specific embodiment the IL-15 cytokine comprises the polypeptide sequence of SEQ ID NO: 2320 [NWVNVISDLKKIEDLIQSMHIDATLYTESDVHP-SCKVTAMKCFLLELQVISLASGDASIH DTVEN-LIILANNSLSSNGAVTESGCKECEELEEKNIKE-FLQSFVHIVQMFINTS]. In one embodiment, the IL-15 cytokine can elicit one or more of the cellular responses selected from the group consisting of: proliferation in an activated T lymphocyte cell, differentiation in an activated T lymphocyte cell, cytotoxic T cell (CTL) activity, proliferation in an activated B cell, differentiation in an activated B cell, proliferation in a natural killer (NK) cell, differentiation in a NK cell, cytokine secretion by an activated T cell or an NK cell, and NK/lymphocyte activated killer (LAK) antitumor cytotoxicity.

Mutant cytokine molecules useful as effector moieties in the multispecific or multifunctional polypeptide can be prepared by deletion, substitution, insertion or modification using genetic or chemical methods well known in the art. Genetic methods may include site-specific mutagenesis of the encoding DNA sequence, PCR, gene synthesis, and the like. The correct nucleotide changes can be verified for example by sequencing. Substitution or insertion may involve natural as well as non-natural amino acid residues. Amino acid modification includes well known methods of chemical modification such as the addition or removal of glycosylation sites or carbohydrate attachments, and the like.

In one embodiment, the cytokine, particularly a single-chain cytokine, of the multispecific or multifunctional polypeptide is GM-CSF. In a specific embodiment, the GM-CSF cytokine can elicit proliferation and/or differentiation in a granulocyte, a monocyte or a dendritic cell. In one embodiment, the cytokine, particularly a single-chain cytokine, of the multispecific or multifunctional polypeptide is IFN-α. In a specific embodiment, the IFN-α cytokine can elicit one or more of the cellular responses selected from the group consisting of: inhibiting viral replication in a virus-infected cell, and upregulating the expression of major histocompatibility complex I (MHC I). In another specific embodiment, the IFN-α cytokine can inhibit proliferation in a tumor cell. In one embodiment the cytokine, particularly a single-chain cytokine, of the multispecific or multifunctional polypeptide is IFNγ. In a specific embodiment, the IFN-γ cytokine can elicit one or more of the cellular responses selected from the group of: increased macrophage activity, increased expression of MHC molecules, and increased NK cell activity. In one embodiment the cytokine, particularly a single-chain cytokine, of the multispecific or multifunctional polypeptide is IL-7. In a specific embodiment, the IL-7 cytokine can elicit proliferation of T and/or B lymphocytes. In one embodiment, the cytokine, particularly a single-chain cytokine, of the multispecific or multifunctional polypeptide is IL-8. In a specific embodiment, the IL-8 cytokine can elicit chemotaxis in neutrophils. In one embodiment, the cytokine, particularly a single-chain cytokine, of the multispecific or multifunctional polypeptide, is MIP-1α. In a specific embodiment, the MIP-1α cytokine can elicit chemotaxis in monocytes and T lymphocyte cells. In one embodiment, the cytokine, particularly a single-chain cytokine, of the multispecific or multifunctional polypeptide is MIP-1β. In a specific embodiment, the MIP-1β cytokine can elicit chemotaxis in monocytes and T lymphocyte cells. In one embodiment, the cytokine, particularly a single-chain cytokine, of the multispecific or multifunctional polypeptide is TGF-β. In a specific embodiment, the TGF-β cytokine can elicit one or more of the cellular responses selected from the group consisting of: chemotaxis in monocytes, chemotaxis in macrophages, upregulation of IL-1 expression in activated macrophages, and upregulation of IgA expression in activated B cells.

In one embodiment, the multispecific or multifunctional polypeptide of the invention binds to an cytokine receptor with a dissociation constant ($K_D$) that is at least about 1, 1.5, 2, 2.5, 3, 3.5, 4, 4.5, 5, 5.5, 6, 6.5, 7, 7.5, 8, 8.5, 9, 9.5 or 10 times greater than that for a control cytokine. In another embodiment, the multispecific or multifunctional polypeptide binds to an cytokine receptor with a $K_D$ that is at least 2, 3, 4, 5, 6, 7, 8, 9, or 10 times greater than that for a corresponding multispecific or multifunctional polypeptide comprising two or more effector moieties. In another embodiment, the multispecific or multifunctional polypeptide binds to an cytokine receptor with a dissociation constant $K_D$ that is about 10 times greater than that for a corresponding the multispecific or multifunctional polypeptide comprising two or more cytokines.

In some embodiments, the multispecific molecules disclosed herein include a cytokine molecule. In embodiments, the cytokine molecule includes a full length, a fragment or a variant of a cytokine; a cytokine receptor domain, e.g., a cytokine receptor dimerizing domain; or an agonist of a cytokine receptor, e.g., an antibody molecule (e.g., an agonistic antibody) to a cytokine receptor.

In some embodiments the cytokine molecule is chosen from IL-2, IL-12, IL-15, IL-18, IL-7, IL-21, or interferon gamma, or a fragment or variant thereof, or a combination of any of the aforesaid cytokines. The cytokine molecule can be a monomer or a dimer. In embodiments, the cytokine molecule can further include a cytokine receptor dimerizing domain.

In other embodiments, the cytokine molecule is an agonist of a cytokine receptor, e.g., an antibody molecule (e.g., an agonistic antibody) to a cytokine receptor chosen from an IL-15Ra or IL-21R.

In one embodiment, the cytokine molecule is IL-15, e.g., human IL-15 (e.g., comprising the amino acid sequence: NWVNVISDLKKIEDLIQSMHIDATLYTESDVHP-SCKVTAMKCFLLELQVISLESGDASIH DTVEN-LIILANNSLSSNGNVTESGCKECEELEEKNIKE-FLQSFVHIVQMFINTS (SEQ ID NO: 2170), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 2170.

In some embodiments, the cytokine molecule comprises a receptor dimerizing domain, e.g., an IL15Ralpha dimerizing domain. In one embodiment, the IL15Ralpha dimerizing domain comprises the amino acid sequence: MAPRRARGCRTLGLPALLLLLLLRPPATR-GITCPPPMSVEHADIWVKSYSLYSRERYICN SGFKRKAGTSSLTECVL (SEQ ID NO: 2180), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 2180. In some embodiments, the cytokine molecule (e.g., IL-15) and the receptor dimerizing domain (e.g., an IL15Ralpha dimerizing domain) of the multispecific molecule are covalently linked, e.g., via a linker (e.g., a Gly-Ser linker, e.g., a linker comprising the amino acid sequence SGGSGGGGSGGGSGGGGSLQ (SEQ ID NO: 2190). In other embodiments, the cytokine molecule (e.g., IL-15) and the receptor dimerizing domain (e.g., an IL15Ralpha dimerizing domain) of the multispecific molecule are not covalently linked, e.g., are non-covalently associated.

In other embodiments, the cytokine molecule is IL-2, e.g., human IL-2 (e.g., comprising the amino acid sequence: APTSSSTKKTQLQLEHLLLDLQMILNGINNYKNPKL-TRMLTFKFYMPKKATELKHLQCL EEELKPLEEVLN-LAQSKNFHLRPRDLISNINVIVLELKGSETTFMCEYA-DETATIVEFLNR WITFCQSIISTLT (SEQ ID NO: 2191), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO:2191).

In other embodiments, the cytokine molecule is IL-18, e.g., human IL-18 (e.g., comprising the amino acid sequence: YFGKLESKLSVIRNLNDQVLFIDQGNR-PLFEDMTDSDCRDNAPRTIFIISMYKDSQPRGM AVTISVKCEKISTLSCENKIISFKEMNPPDNIKDTKS-DIIFFQRSVPGHDNKMQFESSSY EGYFLACEKER-DLFKLILKKEDELGDRSIMFTVQNED (SEQ ID NO: 2192), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 2192).

In other embodiments, the cytokine molecule is IL-21, e.g., human IL-21 (e.g., comprising the amino acid sequence: QGQDRHMIRMRQLIDIVDQLKNYVNDLVPEFLPAPE-DVETNCEWSAFSCFQKAQLKSA NTGNNERIINVSIK-KLKRKPPSTNAGRRQKHRLTCPSCDSYEKKPPKE-FLERFKSLLQKMI HQHLSSRTHGSEDS (SEQ ID NO: 2193), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 2193).

In yet other embodiments, the cytokine molecule is interferon gamma, e.g., human interferon gamma (e.g., comprising the amino acid sequence: QDPYVKEAENLKKYFNAGHSD-VADNGTLFLGILKNWKEESDRKIMQSQIVSFYFKLFK NFKDDQSIQKSVETIKEDMNVKFFNSNKKKRDD-FEKLTNYSVTDLNVQRKAIHELIQVM AEL-SPAAKTGKRKRSQMLFRG (SEQ ID NO: 2194), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 2194).

Immune Cell Engagers

The immune cell engagers, e.g., first and/or second immune cell engager, of the multispecific or multifunctional molecules disclosed herein can mediate binding to, and/or activation of, an immune cell, e.g., an immune effector cell. In some embodiments, the immune cell is chosen from a T cell, an NK cell, a B cell, a dendritic cell, or a macrophage cell engager, or a combination thereof. In some embodiments, the immune cell engager is chosen from one, two, three, or all of a T cell engager, NK cell engager, a B cell engager, a dendritic cell engager, or a macrophage cell engager, or a combination thereof. The immune cell engager can be an agonist of the immune system. In some embodiments, the immune cell engager can be an antibody molecule, a ligand molecule (e.g., a ligand that further comprises an immunoglobulin constant region, e.g., an Fc region), a small molecule, a nucleotide molecule.

Natural Killer Cell Engagers

Natural Killer (NK) cells recognize and destroy tumors and virus-infected cells in an antibody-independent manner. The regulation of NK cells is mediated by activating and inhibiting receptors on the NK cell surface. One family of activating receptors is the natural cytotoxicity receptors (NCRs) which include NKp30, NKp44 and NKp46. The NCRs initiate tumor targeting by recognition of heparan sulfate on cancer cells. NKG2D is a receptor that provides both stimulatory and costimulatory innate immune responses on activated killer (NK) cells, leading to cytotoxic activity. DNAM1 is a receptor involved in intercellular adhesion, lymphocyte signaling, cytotoxicity and lymphokine secretion mediated by cytotoxic T-lymphocyte (CTL) and NK cell. DAP10 (also known as HCST) is a transmembrane adapter protein which associates with KLRK1 to form an activation receptor KLRK1-HCST in lymphoid and myeloid cells; this receptor plays a major role in triggering cytotoxicity against target cells expressing cell surface ligands such as WIC class I chain-related MICA and MICB, and U(optionally L1)6-binding proteins (ULBPs); it KLRK1-HCST receptor plays a role in immune surveillance against tumors and is required for cytolysis of tumors cells; indeed, melanoma cells that do not express KLRK1 ligands escape from immune surveillance mediated by NK cells. CD16 is a receptor for the Fc region of IgG, which binds complexed or aggregated IgG and also monomeric IgG and thereby mediates antibody-dependent cellular cytotoxicity (ADCC) and other antibody-dependent responses, such as phagocytosis.

In some embodiments, the NK cell engager is a viral hemagglutinin (HA), HA is a glycoprotein found on the surface of influenza viruses. It is responsible for binding the virus to cells with sialic acid on the membranes, such as cells in the upper respiratory tract or erythrocytes. HA has at least 18 different antigens. These subtypes are named H1 through H18. NCRs can recognize viral proteins. NKp46 has been shown to be able to interact with the HA of influenza and the HA-NA of Paramyxovirus, including Sendai virus and Newcastle disease virus. Besides NKp46, NKp44 can also functionally interact with HA of different influenza subtypes.

The present disclosure provides, inter alia, multispecific (e.g., bi-, tri-, quad-specific) or multifunctional molecules, that are engineered to contain one or more NK cell engagers that mediate binding to and/or activation of an NK cell. Accordingly, in some embodiments, the NK cell engager is selected from an antigen binding domain or ligand that binds to (e.g., activates): NKp30, NKp40, NKp44, NKp46, NKG2D, DNAM1, DAP 10, CD16 (e.g., CD 16a, CD 16b, or both), CRTAM, CD27, PSGL1, CD96, CD100 (SEMA4D), NKp80, CD244 (also known as SLAMF4 or 2B4), SLAMF6, SLAMF7, KIR2DS2, KIR2DS4, KIR3DS1, KIR2DS3, KIR2DS5, KIR2DS1, CD94, NKG2C, NKG2E, or CD 160.

In one embodiment, the NK cell engager is a ligand of NKp30 is a B7-6, e.g., comprises the amino acid sequence of:
DLKVEMMAGGTQITPLNDNVTIFCNI-FYSQPLNITSMGITWFWKSLTFDKEVKVFEFFGD HQEAFRPGAIVSPWRLKSGDASLRLPGIQLEEAGEY-RCEVVVTPLKAQGTVQLEVVASP ASRLLL-DQVGMKENEDKYMCESSGFYPEAINIT-WEKQTQKFPHPIEISEDVITGPTIKNM DGTFNVTSCLKLNSSQEDPGTVYQCVVRHAS-LHTPLRSNFTLTAARHSLSETEKTDNFS (SEQ ID NO: 3291), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3291.

In other embodiments, the NK cell engager is a ligand of NKp44 or NKp46, which is a viral HA. Viral hemagglutinins (HA) are glyco proteins which are on the surface of viruses. HA proteins allow viruses to bind to the membrane of cells via sialic acid sugar moieties which contributes to the fusion of viral membranes with the cell membranes (see e.g., Eur J Immunol. 2001 September; 31(9):2680-9 "Recognition of viral hemagglutinins by NKp44 but not by NKp30"; and Nature. 2001 Feb. 22; 409(6823):1055-60 "Recognition of haemagglutinins on virus-infected cells by NKp46 activates lysis by human NK cells" the contents of each of which are incorporated by reference herein).

In other embodiments, the NK cell engager is a ligand of NKG2D chosen from MICA, MICB, or ULBP1, e.g., wherein:

(i) MICA comprises the amino acid sequence: EPHSLRYNLTVLSWDGSVQSGFLTEVHLDGQP-FLRCDRQKCRAKPQGQWAEDVLGNK TWDRETRDLTGNGKDLRMTLAHIKDQKEG-LHSLQEIRVCEIHEDNSTRSSQHFYYDGEL FLSQN-LETKEWTMPQSSRAQTLAMNVRNFLKE-DAMKTKTHYHAMHADCLQELRRYLK SGVVLRRTVPPMVNVTRSEASEGNITVT-CRASGFYPWNITLSWRQDGVSLSHDTQQWG DVLPDGNGTYQTWVATRICQGEEQRFT-CYMEHSGNHSTHPVPSGKVLVLQSHW (SEQ ID NO: 3292), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3292;

(ii) MICB comprises the amino acid sequence: AEPHSLRYNLMVLSQDESVQSGFLAEGHLDGQPFL-RYDRQKRRAKPQGQWAEDVLGA KTWDTET-EDLTENGQDLRRTLTHIKDQKGGLHSLQEIRVCEI-HEDSSTRGSRHFYYDGEL FLSQNLETQESTVPQSSRAQTLAMNVTNFWKE-DAMKTKTHYRAMQADCLQKLQRYLK SGVAIRRTVPPMVNVTCSEVSEGNITVTCRASSFYPR-NITLTWRQDGVSLSHNTQQWGD VLPDGNGTYQTW-VATRIRQGEEQRFTCYMEHSGNHGTH-PVPSGKVLVLQSQRTD (SEQ ID NO: 3293), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3293; or (iii) ULBP1 comprises the amino acid sequence: GWVDTHCLCYDFIITPKSRPEPQWCEVQGLVDERP-FLHYDCVNHKAKAFASLGKKVNV TKTWE-EQTETLRDVVDFLKGQLLDIQVENLIPIE-PLTLQARMSCEHEAHGHGRGSWQFL FNGQKFLLFDSNNRKWTALHPGAKKMTEK-WEKNRDVTMFFQKISLGDCKMWLEEFL MYWEQMLDPTKPPSLAPG (SEQ ID NO: 3294), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3294.

In other embodiments, the NK cell engager is a ligand of DNAM1 chosen from NECTIN2 or NECL5, e.g., wherein:

(i) NECTIN2 comprises the amino acid sequence: QDVRVQVLPEVRGQLGGTVELPCHLLPPVPGLYIS-LVTWQRPDAPANHQNVAAFHPKM GPSFPSPKPG-SERLSFVSAKQSTGQDTEAELQDATLALHGLTVEDE-GNYTCEFATFPKGS VRGMTWLRVIAKPKNQAEAQKVTFSQDPTTVAL-CISKEGRPPARISWLSSLDWEAKETQ VSGT-LAGTVTVTSRFTLVPSGRADGVTVTCKVEHESFEEP-ALIPVTLSVRYPPEVSISGYD DNWYLGRTDATLSCDVRSNPEPTGYDWSTTSGTFPT-SAVAQGSQLVIHAVDSLFNTTFV CTVT-NAVGMGRAEQVIFVRETPNTAGAGATGG (SEQ ID NO: 3295), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3295; or (ii) NECL5 comprises the amino acid sequence: WPPPGTGDVVVQAPTQVPGFLGDSVTLPCYLQVPN-MEVTHVSQLTWARHGESGSMAV FHQTQGPSYS-ESKRLEFVAARLGAELRNASLRMFGLRVEDEGNYT-CLFVTFPQGSRSVD IWLRVLAKPQNTAEVQKVQLTGEPVPMARCVSTG-GRPPAQITWHSDLGGMPNTSQVPG FLSGTVTVT-SLWILVPSSQVDGKNVTCKVEHES-FEKPQLLTVNLTVYYPPEVSISGYDNN WYLGQNEATLTCDARSNPEPTGYNWSTTMGPLPP-FAVAQGAQLLIRPVDKPINTTLICN VTNALGAR-QAELTVQVKEGPPSEHSGISRN (SEQ ID NO: 3296), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3296.

In yet other embodiments, the NK cell engager is a ligand of DAP10, which is an adapter for NKG2D (see e.g., Proc Natl Acad Sci USA. 2005 May 24; 102(21): 7641-7646; and Blood, 15 Sep. 2011 Volume 118, Number 11, the full contents of each of which is incorporated by reference herein).

In other embodiments, the NK cell engager is a ligand of CD16, which is a CD16a/b ligand, e.g., a CD16a/b ligand further comprising an antibody Fc region (see e.g., Front Immunol. 2013; 4: 76 discusses how antibodies use the Fc to trigger NK cells through CD16, the full contents of which are incorporated herein).

In other embodiments, the NK cell engager is a ligand of CRTAM, which is NECL2, e.g., wherein NECL2 comprises the amino acid sequence: QNLFTKDVTVIEGEVA-TISCQVNKSDDSVIQLLNPNRQTIYFRDFR-PLKDSRFQLLNFSSS ELKVSLTNVSISDE-GRYFCQLYTDPPQESYTTITVLVPPRNLMIDIQKD-TAVEGEEIEVNC TAMASKPATTIRWFKGNTELKGK-SEVEEWSDMYTVTSQLMLKVHKEDDGVPVICQVE HPAVTGNLQTQRYLEVQYKPQVHIQMTYPLQGL-TREGDALELTCEAIGKPQPVMVTWV RVD-DEMPQHAVLSGPNLFINNLNKTDNGTYRCEASNIV-GKAHSDYMLYVYDPPTTIPPP TTTTTTTTTTTTTILTIITDSRAGEEGSIRAVDH (SEQ ID NO: 3297), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3297.

In other embodiments, the NK cell engager is a ligand of CD27, which is CD70, e.g., wherein CD70 comprises the amino acid sequence: QRFAQAQQQLPLESLGWDVAELQLNHTGPQQDPRLYWQGGPALGRSFLHGPELDKGQ LRIHRDGIYMVHIQVTLAICSSTTASRHHPTTLAVGICSPASRSISLLRLSFHQGCTIASQR LTPLARGDTLCTNLTGTLLPSRNTDETFFGVQWVRP (SEQ ID NO: 3298), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3298.

In other embodiments, the NK cell engager is a ligand of PSGL1, which is L-selectin (CD62L), e.g., wherein L-selectin comprises the amino acid sequence: WTYHYSEKPMNWQRARRFCRDNYTDLVAIQNKAEIEYLEKTLPFSRSYYWIGIRKIGGI WTWVGTNKSLTEEAENWGDGEPNNKKNKEDCVEIYIKRNKDAGKWNDDACHKLKAA LCYTASCQPWSCSGHGECVEIINNYTCNCDVGYYGPQCQFVIQCEPLEAPELGTMDCTH PLGNFSFSSQCAFSCSEGTNLTGIEETTCGPFGNWSSPEPTCQVIQCEPLSAPDLGIMNCSH PLASFSFTSACTFICSEGTELIGKKKTICESSGIWSNPSPICQKLDKSFSMIKEGDYN (SEQ ID NO: 3299), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3299.

In other embodiments, the NK cell engager is a ligand of CD96, which is NECL5, e.g., wherein NECL5 comprises the amino acid sequence: WPPPGTGDVVVQAPTQVPGFLGDSVTLPCYLQVPNMEVTHVSQLTWARHGESGSMAV FHQTQGPSYSESKRLEFVAARLGAELRNASLRMFGLRVEDEGNYTCLFVTFPQGSRSVD IWLRVLAKPQNTAEVQKVQLTGEPVPMARCVSTGGRPPAQITWHSDLGGMPNTSQVPG FLSGTVTVTSLWILVPSSQVDGKNVTCKVEHESFEKPQLLTVNLTVYYPPEVSISGYDNN WYLGQNEATLTCDARSNPEPTGYNWSTTMGPLPPFAVAQGAQLLIRPVDKPINTTLICN VTNALGARQAELTVQVKEGPPSEHSGISRN (SEQ ID NO: 3296), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3296.

In other embodiments, the NK cell engager is a ligand of CD100 (SEMA4D), which is CD72, e.g., wherein CD72 comprises the amino acid sequence: RYLQVSQQLQQTNRVLEVTNSSLRQQLRLKITQLGQSAEDLQGSRRELAQSQEALQVEQ RAHQAAEGQLQACQADRQKTKETLQSEEQQRRALEQKLSNMENRLKPFFTCGSADTCC PSGWIMHQKSCFYISLTSKNWQESQKQCETLSSKLATFSEIYPQSHSYYFLNSLLPNGGS GNSYWTGLSSNKDWKLTDDTQRTRTYAQSSKCNKVHKTWSWWTLESESCRSSLPYICE MTAFRFPD (SEQ ID NO: 3300), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3300.

In other embodiments, the NK cell engager is a ligand of NKp80, which is CLEC2B (AICL), e.g., wherein CLEC2B (AICL) comprises the amino acid sequence: KLTRDSQSLCPYDWIGFQNKCYYFSKEEGDWNSSKYNCSTQHADLTIIDNIEEMNFLRR YKCSSDHWIGLKMAKNRTGQWVDGATFTKSFGMRGSEGCAYLSDDGAATARCYTER KWICRKRIH (SEQ ID NO: 3301), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3301.

In other embodiments, the NK cell engager is a ligand of CD244, which is CD48, e.g., wherein CD48 comprises the amino acid sequence: QGHLVHMTVVSGSNVTLNISESLPENYKQLTWFYTFDQKIVEWDSRKSKYFESKFKGR VRLDPQSGALYISKVQKEDNSTYIMRVLKKTGNEQEWKIKLQVLDPVPKPVIKIEKIEDM DDNCYLKLSCVIPGESVNYTWYGDKRPFPKELQNSVLETTLMPHNYSRCYTCQVSNSVS SKNGTVCLSPPCTLARS (SEQ ID NO: 3302), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3302.

T Cell Engagers

The present disclosure provides, inter alia, multispecific (e.g., bi-, tri-, quad-specific) or multifunctional molecules, that are engineered to contain one or more T cell engager that mediate binding to and/or activation of a T cell. In some embodiments, the T cell engager is an antigen binding domain that binds to, e.g., activates TCRβ, e.g., a TCRβV region, as described herein. In some embodiments, the T cell engager is selected from an antigen binding domain or ligand that binds to (e.g., and in some embodiments activates) one or more of CD3, TCRα, TCRγ, TCRζ, ICOS, CD28, CD27, HVEM, LIGHT, CD40, 4-1BB, OX40, DR3, GITR, CD30, TIM1, SLAM, CD2, or CD226. In other embodiments, the T cell engager is selected from an antigen binding domain or ligand that binds to and does not activate one or more of CD3, TCRα, TCRγ, TCRζ, ICOS, CD28, CD27, HVEM, LIGHT, CD40, 4-1BB, OX40, DR3, GITR, CD30, TIM1, SLAM, CD2, or CD226.

B Cell, Macrophage & Dendritic Cell Engagers

Broadly, B cells, also known as B lymphocytes, are a type of white blood cell of the lymphocyte subtype. They function in the humoral immunity component of the adaptive immune system by secreting antibodies. Additionally, B cells present antigen (they are also classified as professional antigen-presenting cells (APCs)) and secrete cytokines. Macrophages are a type of white blood cell that engulfs and digests cellular debris, foreign substances, microbes, cancer cells via phagocytosis. Besides phagocytosis, they play important roles in nonspecific defense (innate immunity) and also help initiate specific defense mechanisms (adaptive immunity) by recruiting other immune cells such as lymphocytes. For example, they are important as antigen presenters to T cells. Beyond increasing inflammation and stimulating the immune system, macrophages also play an important anti-inflammatory role and can decrease immune reactions through the release of cytokines. Dendritic cells (DCs) are antigen-presenting cells that function in processing antigen material and present it on the cell surface to the T cells of the immune system.

The present disclosure provides, inter alia, multispecific (e.g., bi-, tri-, quad-specific) or multifunctional molecules, that include, e.g., are engineered to contain, one or more B cell, macrophage, and/or dendritic cell engager that mediate binding to and/or activation of a B cell, macrophage, and/or dendritic cell.

Accordingly, in some embodiments, the immune cell engager comprises a B cell, macrophage, and/or dendritic cell engager chosen from one or more of CD40 ligand (CD40L) or a CD70 ligand; an antibody molecule that binds to CD40 or CD70; an antibody molecule to OX40; an OX40 ligand (OX40L); an agonist of a Toll-like receptor (e.g., as described herein, e.g., a TLR4, e.g., a constitutively active TLR4 (caTLR4), or a TLR9 agonists); a 41BB; a CD2; a CD47; or a STING agonist, or a combination thereof.

In some embodiments, the B cell engager is a CD40L, an OX40L, or a CD70 ligand, or an antibody molecule that binds to OX40, CD40 or CD70.

In some embodiments, the macrophage engager is a CD2 agonist. In some embodiments, the macrophage engager is an antigen binding domain that binds to: CD40L or antigen binding domain or ligand that binds CD40, a Toll like receptor (TLR) agonist (e.g., as described herein), e.g., a TLR9 or TLR4 (e.g., caTLR4 (constitutively active TLR4), CD47, or a STING agonist. In some embodiments, the STING agonist is a cyclic dinucleotide, e.g., cyclic di-GMP (cdGMP) or cyclic di-AMP (cdAMP). In some embodiments, the STING agonist is biotinylated.

In some embodiments, the dendritic cell engager is a CD2 agonist. In some embodiments, the dendritic cell engager is a ligand, a receptor agonist, or an antibody molecule that binds to one or more of: OX40L, 41BB, a TLR agonist (e.g., as described herein) (e.g., TLR9 agonist, TLR4 (e.g., caTLR4 (constitutively active TLR4)), CD47, or and a STING agonist. In some embodiments, the STING agonist is a cyclic dinucleotide, e.g., cyclic di-GMP (cdGMP) or cyclic di-AMP (cdAMP). In some embodiments, the STING agonist is biotinylated.

In other embodiments, the immune cell engager mediates binding to, or activation of, one or more of a B cell, a macrophage, and/or a dendritic cell. Exemplary B cell, macrophage, and/or dendritic cell engagers can be chosen from one or more of CD40 ligand (CD40L) or a CD70 ligand; an antibody molecule that binds to CD40 or CD70; an antibody molecule to OX40; an OX40 ligand (OX40L); a Toll-like receptor agonist (e.g., a TLR4, e.g., a constitutively active TLR4 (caTLR4) or a TLR9 agonist); a 41BB agonist; a CD2; a CD47; or a STING agonist, or a combination thereof.

In some embodiments, the B cell engager is chosen from one or more of a CD40L, an OX40L, or a CD70 ligand, or an antibody molecule that binds to OX40, CD40 or CD70.

In other embodiments, the macrophage cell engager is chosen from one or more of a CD2 agonist; a CD40L; an OX40L; an antibody molecule that binds to OX40, CD40 or CD70; a Toll-like receptor agonist or a fragment thereof (e.g., a TLR4, e.g., a constitutively active TLR4 (caTLR4)); a CD47 agonist; or a STING agonist.

In other embodiments, the dendritic cell engager is chosen from one or more of a CD2 agonist, an OX40 antibody, an OX40L, 41BB agonist, a Toll-like receptor agonist or a fragment thereof (e.g., a TLR4, e.g., a constitutively active TLR4 (caTLR4)), CD47 agonist, or a STING agonist.

In one embodiment, the OX40L comprises the amino acid sequence:
QVSHRYPRIQSIKVQFTEYKKEKGFILTSQKEDE-IMKVQNNSVIINCDGFYLISLKGYFSQ EVN-ISLHYQKDEEP-LFQLKKVRSVNSLMVASLTYKDKVYLNVTTDNT-SLDDFHVNGGE LILIHQNPGEFCVL (SEQ ID NO: 3303), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3303.

In another embodiment, the CD40L comprises the amino acid sequence:
MQKGDQNPQIAAHVISEAS-SKTTSVLQWAEKGYYTMSNNLVT-LENGKQLTVKRQGLY YIYAQVTFCSNREASSQAP-FIASLCLKSPGRFERILLRAANTHSSAKPCGQQSIH-LGGVFE LQPGASVFVNVTDP-SQVSHGTGFTSFGLLKL (SEQ ID NO: 3304), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3304.

In yet other embodiments, the STING agonist comprises a cyclic dinucleotide, e.g., a cyclic di-GMP (cdGMP), a cyclic di-AMP (cdAMP), or a combination thereof, optionally with 2',5' or 3',5' phosphate linkages.

In one embodiment, the immune cell engager includes 41BB ligand, e.g., comprising the amino acid sequence:
ACPWAVSGARASPGSAASPRLREGPELSPDD-PAGLLDLRQGMFAQLVAQNVLLIDGPLS WYSDPGLAGVSLTGGLSYKEDTKELVVAK-AGVYYVFFQLELRRVVAGEGSGSVSLALH LQPLR-SAAGAAALALTVDLPPASSEARNSAFGFQGRLLHL-SAGQRLGVHLHTEARARH AWQLTQGATVLGLFRVTPEIPAGLPSPRSE (SEQ ID NO: 3305), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3305.

Toll-Like Receptors

Toll-Like Receptors (TLRs) are evolutionarily conserved receptors are homologues of the *Drosophila* Toll protein, and recognize highly conserved structural motifs known as pathogen-associated microbial patterns (PAMPs), which are exclusively expressed by microbial pathogens, or danger-associated molecular patterns (DAMPs) that are endogenous molecules released from necrotic or dying cells. PAMPs include various bacterial cell wall components such as lipopolysaccharide (LPS), peptidoglycan (PGN) and lipopeptides, as well as flagellin, bacterial DNA and viral double-stranded RNA. DAMPS include intracellular proteins such as heat shock proteins as well as protein fragments from the extracellular matrix. Stimulation of TLRs by the corresponding PAMPs or DAMPs initiates signaling cascades leading to the activation of transcription factors, such as AP-1, NF-κB and interferon regulatory factors (IRFs). Signaling by TLRs results in a variety of cellular responses, including the production of interferons (IFNs), pro-inflammatory cytokines and effector cytokines that direct the adaptive immune response. TLRs are implicated in a number of inflammatory and immune disorders and play a role in cancer (Rakoff-Nahoum S. & Medzhitov R., 2009. Toll-like receptors and cancer. Nat Revs Cancer 9:57-63.)

TLRs are type I transmembrane proteins characterized by an extracellular domain containing leucine-rich repeats (LRRs) and a cytoplasmic tail that contains a conserved region called the Toll/IL-1 receptor (TIR) domain. Ten human and twelve murine TLRs have been characterized, TLR1 to TLR10 in humans, and TLR1 to TLR9, TLR11, TLR12 and TLR13 in mice, the homolog of TLR10 being a pseudogene. TLR2 is essential for the recognition of a variety of PAMPs from Gram-positive bacteria, including bacterial lipoproteins, lipomannans and lipoteichoic acids. TLR3 is implicated in virus-derived double-stranded RNA. TLR4 is predominantly activated by lipopolysaccharide. TLR5 detects bacterial flagellin and TLR9 is required for response to unmethylated CpG DNA. Finally, TLR7 and TLR8 recognize small synthetic antiviral molecules, and single-stranded RNA was reported to be their natural ligand. TLR11 has been reported to recognize uropathogenic *E. coli* and a profilin-like protein from *Toxoplasma gondii*. The repertoire of specificities of the TLRs is apparently extended by the ability of TLRs to heterodimerize with one another. For example, dimers of TLR2 and TLR6 are required for responses to diacylated lipoproteins while TLR2 and TLR1 interact to recognize triacylated lipoproteins. Specificities of the TLRs are also influenced by various adapter and accessory molecules, such as MD-2 and CD 14 that form a complex with TLR4 in response to LPS.

TLR signaling consists of at least two distinct pathways: a MyD88-dependent pathway that leads to the production of inflammatory cytokines, and a MyD88-independent pathway associated with the stimulation of IFN-0 and the maturation of dendritic cells. The MyD88-dependent pathway is common to all TLRs, except TLR3 (Adachi O. et al., 1998. Targeted disruption of the MyD88 gene results in loss of IL-1- and IL-18-mediated function. Immunity. 9(1):143-50). Upon activation by PAMPs or DAMPs, TLRs hetero- or homodimerize inducing the recruitment of adaptor proteins via the cytoplasmic TIR domain. Individual TLRs induce different signaling responses by usage of the different adaptor molecules. TLR4 and TLR2 signaling requires the adaptor TIRAP/Mal, which is involved in the MyD88-dependent pathway. TLR3 triggers the production of IFN-β in response to double-stranded RNA, in a MyD88-independent manner, through the adaptor TRIF/TICAM-1. TRAM/TICAM-2 is another adaptor molecule involved in the MyD88-independent pathway which function is restricted to the TLR4 pathway.

TLR3, TLR7, TLR8 and TLR9 recognize viral nucleic acids and induce type I IFNs. The signaling mechanisms leading to the induction of type I IFNs differ depending on the TLR activated. They involve the interferon regulatory factors, IRFs, a family of transcription factors known to play a critical role in antiviral defense, cell growth and immune regulation. Three IRFs (IRF3, IRF5 and IRF7) function as direct transducers of virus-mediated TLR signaling. TLR3 and TLR4 activate IRF3 and IRF7, while TLR7 and TLR8 activate IRF5 and IRF7 (Doyle S. et al., 2002. IRF3 mediates a TLR3/TLR4-specific antiviral gene program. Immunity. 17(3):251-63). Furthermore, type I IFN production stimulated by TLR9 ligand CpG-A has been shown to be mediated by PI(3)K and mTOR (Costa-Mattioli M. & Sonenberg N. 2008. RAPping production of type I interferon in pDCs through mTOR. Nature Immunol. 9: 1097-1099).

TLR-9

TLR9 recognizes unmethylated CpG sequences in DNA molecules. CpG sites are relatively rare (~1%) on vertebrate genomes in comparison to bacterial genomes or viral DNA. TLR9 is expressed by numerous cells of the immune system such as B lymphocytes, monocytes, natural killer (NK) cells, and plasmacytoid dendritic cells. TLR9 is expressed intracellularly, within the endosomal compartments and functions to alert the immune system of viral and bacterial infections by binding to DNA rich in CpG motifs. TLR9 signals leads to activation of the cells initiating pro-inflammatory reactions that result in the production of cytokines such as type-I interferon and IL-12.

TLR Agonists

A TLR agonist can agonize one or more TLR, e.g., one or more of human TLR-1, 2, 3, 4, 5, 6, 7, 8, 9, or 10. In some embodiments, an adjunctive agent described herein is a TLR agonist. In some embodiments, the TLR agonist specifically agonizes human TLR-9. In some embodiments, the TLR-9 agonist is a CpG moiety. As used herein, a CpG moiety, is a linear dinucleotide having the sequence: 5'-C-phosphate-G-3', that is, cytosine and guanine separated by only one phosphate.

In some embodiments, the CpG moiety comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more CpG dinucleotides. In some embodiments, the CpG moiety consists of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 CpG dinucleotides. In some embodiments, the CpG moiety has 1-5, 1-10, 1-20, 1-30, 1-40, 1-50, 5-10, 5-20, 5-30, 10-20, 10-30, 10-40, or 10-50 CpG dinucleotides.

In some embodiments, the TLR-9 agonist is a synthetic ODN (oligodeoxynucleotides). CpG ODNs are short synthetic single-stranded DNA molecules containing unmethylated CpG dinucleotides in particular sequence contexts (CpG motifs). CpG ODNs possess a partially or completely phosphorothioated (PS) backbone, as opposed to the natural phosphodiester (PO) backbone found in genomic bacterial DNA. There are three major classes of CpG ODNs: classes A, B and C, which differ in their immunostimulatory activities. CpG-A ODNs are characterized by a PO central CpG-containing palindromic motif and a PS-modified 3' poly-G string. They induce high IFN-α production from pDCs but are weak stimulators of TLR9-dependent NF-κB signaling and pro-inflammatory cytokine (e.g. IL-6) production. CpG-B ODNs contain a full PS backbone with one or more CpG dinucleotides. They strongly activate B cells and TLR9-dependent NF-κB signaling but weakly stimulate IFN-α secretion. CpG-C ODNs combine features of both classes A and B. They contain a complete PS backbone and a CpG-containing palindromic motif. C-Class CpG ODNs induce strong IFN-α production from pDC as well as B cell stimulation.

Tumor-Targeting Moieties

The present disclosure provides, inter alia, multispecific (e.g., bi-, tri-, tetra-specific) molecules, that include, e.g., are engineered to contain, one or more tumor specific targeting moieties that direct the molecule to a tumor cell.

In certain embodiments, the multispecific molecules disclosed herein include a tumor-targeting moiety. The tumor targeting moiety can be chosen from an antibody molecule (e.g., an antigen binding domain as described herein), a receptor or a receptor fragment, or a ligand or a ligand fragment, or a combination thereof. In some embodiments, the tumor targeting moiety associates with, e.g., binds to, a tumor cell (e.g., a molecule, e.g., antigen, present on the surface of the tumor cell). In certain embodiments, the tumor targeting moiety targets, e.g., directs the multispecific molecules disclosed herein to a cancer (e.g., a cancer or tumor cells). In some embodiments, the cancer is chosen from a hematological cancer, a solid cancer, a metastatic cancer, or a combination thereof.

In some embodiments, the multispecific molecule, e.g., the tumor-targeting moiety, binds to a solid tumor antigen or a stromal antigen. The solid tumor antigen or stromal antigen can be present on a solid tumor, or a metastatic lesion thereof. In some embodiments, the solid tumor is chosen from one or more of pancreatic (e.g., pancreatic adenocarcinoma), breast, colorectal, lung (e.g., small or non-small cell lung cancer), skin, ovarian, or liver cancer. In one embodiment, the solid tumor is a fibrotic or desmoplastic solid tumor. For example, the solid tumor antigen or stromal antigen can be present on a tumor, e.g., a tumor of a class typified by having one or more of: limited tumor perfusion, compressed blood vessels, or fibrotic tumor interstitium.

In certain embodiments, the solid tumor antigen is chosen from one or more of: PDL1, CD47, ganglioside 2 (GD2), prostate stem cell antigen (PSCA), prostate specific membrane antigen (PMSA), prostate-specific antigen (PSA), carcinoembryonic antigen (CEA), Ron Kinase, c-Met, Immature laminin receptor, TAG-72, BING-4, Calcium-activated chloride channel 2, Cyclin-B 1, 9D7, Ep-CAM, EphA3, Her2/neu, Telomerase, SAP-1, Survivin, NY-ESO-1/LAGE-1, PRAME, SSX-2, Melan-A/MART-1, Gp100/pme117, Tyrosinase, TRP-1/-2, MC1R, β-catenin, BRCA1/2, CDK4, CML66, Fibronectin, p53, Ras, TGF-B receptor, AFP, ETA, MAGE, MUC-1, CA-125, BAGE, GAGE, NY-ESO-1, β-catenin, CDK4, CDC27, CD47, a actinin-4, TRP1/gp75, TRP2, gp100, Melan-A/MART 1, gangliosides, WT 1, EphA3, Epidermal growth factor receptor (EGFR), MART-2, MART-1, MUC1, MUC2, MUM1, MUM2, MUM3, NA88-1, NPM, OA1, OGT, RCC, RUI1, RUI2, SAGE, TRG, TRP1, TSTA, Folate receptor alpha, L1-CAM, CAIX, EGFRvIII, gpA33, GD3, GM2, VEGFR, Intergrins (Integrin alphaVbeta3, Integrin alpha5Beta1), Carbohydrates (Le), IGF1R, EPHA3, TRAILR1, TRAILR2, or RANKL.

In other embodiments, the multispecific molecule, e.g., the tumor-targeting moiety, binds to a molecule, e.g., antigen, present on the surface of a hematological cancer, e.g., a leukemia or a lymphoma. In some embodiments, the hematological cancer is a B-cell or T cell malignancy. In some embodiments, the hematological cancer is chosen from one or more of a Hodgkin's lymphoma, Non-Hodgkin's lymphoma (e.g., B cell lymphoma, diffuse large B cell lymphoma, follicular lymphoma, chronic lymphocytic leukemia, mantle cell lymphoma, marginal zone B-cell lymphoma, Burkitt lymphoma, lymphoplasmacytic lymphoma, hairy cell leukemia), acute myeloid leukemia (AML), chronic myeloid leukemia, myelodysplastic syndrome (MDS), multiple myeloma, or acute lymphocytic leukemia. In embodiments, the cancer is other than acute myeloid leukemia (AML) or myelodysplastic syndrome (MDS). In embodiments, the hematological antigen is chosen from CD47, CD99, CD30, CD38, SLAMF7, or NY-ESO1. In some embodiments, the hematological antigen is chosen from is chosen from one or more of: BCMA, CD19, CD20, CD22, CD33, CD123, FcRH5, CLEC12, or CD179A.

Stromal Modifying Moieties

Solid tumors have a distinct structure that mimics that of normal tissues and comprises two distinct but interdependent compartments: the parenchyma (neoplastic cells) and the stroma that the neoplastic cells induce and in which they are dispersed. All tumors have stroma and require stroma for nutritional support and for the removal of waste products. In the case of tumors which grow as cell suspensions (e.g., leukemias, ascites tumors), the blood plasma serves as stroma (Connolly J L et al. Tumor Structure and Tumor Stroma Generation. In: Kufe D W et al., editors. Holland-Frei *Cancer Medicine*. 6th edition. Hamilton: BC Decker; 2003). The stroma includes a variety of cell types, including fibroblasts/myofibroblasts, glial, epithelial, fat, vascular, smooth muscle, and immune cells along with extracellular matrix (ECM) and extracellular molecules (Li Hanchen et al. Tumor Microenvironment: The Role of the Tumor Stroma in Cancer. *J of Cellular Biochemistry* 101: 805-815 (2007)).

Stromal modifying moieties described herein include moieties (e.g., proteins, e.g., enzymes) capable of degrading a component of the stroma, e.g., an ECM component, e.g., a glycosaminoglycan, e.g., hyaluronan (also known as hyaluronic acid or HA), chondroitin sulfate, chondroitin, dermatan sulfate, heparin sulfate, heparin, entactin, tenascin, aggrecan and keratin sulfate; or an extracellular protein, e.g., collagen, laminin, elastin, fibrinogen, fibronectin, and vitronectin.

Stromal Modifying Enzymes

In some embodiments, the stromal modifying moiety is an enzyme. For example, the stromal modifying moiety can include, but is not limited to a hyaluronidase, a collagenase, a chondroitinase, a matrix metalloproteinase (e.g., macrophage metalloelastase).

Hyaluronidases

Hyaluronidases are a group of neutral- and acid-active enzymes found throughout the animal kingdom. Hyaluronidases vary with respect to substrate specificity, and mechanism of action. There are three general classes of hyaluronidases: (1) Mammalian-type hyaluronidases, (EC 3.2.1.35) which are endo-beta-N-acetylhexosaminidases with tetrasaccharides and hexasaccharides as the major end products. They have both hydrolytic and transglycosidase activities, and can degrade hyaluronan and chondroitin sulfates; (2) Bacterial hyaluronidases (EC 4.2.99.1) degrade hyaluronan and, and to various extents, chondroitin sulfate and dermatan sulfate. They are endo-beta-N-acetylhexosaminidases that operate by a beta elimination reaction that yields primarily disaccharide end products; (3) Hyaluronidases (EC 3.2.1.36) from leeches, other parasites, and crustaceans are endo-beta-glucuronidases that generate tetrasaccharide and hexasaccharide end products through hydrolysis of the beta 1-3 linkage.

Mammalian hyaluronidases can be further divided into two groups: (1) neutral active and (2) acid active enzymes. There are six hyaluronidase-like genes in the human genome, HYAL1, HYAL2, HYAL3 HYAL4 HYALP1 and PH20/SPAM1. HYALP1 is a pseudogene, and HYAL3 has not been shown to possess enzyme activity toward any known substrates. HYAL4 is a chondroitinase and lacks activity towards hyaluronan. HYAL1 is the prototypical acid-active enzyme and PH20 is the prototypical neutral-active enzyme. Acid active hyaluronidases, such as HYAL1 and HYAL2 lack catalytic activity at neutral pH. For example, HYAL1 has no catalytic activity in vitro over pH 4.5 (Frost and Stern, "A Microtiter-Based Assay for Hyaluronidase Activity Not Requiring Specialized Reagents", Analytical Biochemistry, vol. 251, pp. 263-269 (1997). HYAL2 is an acid active enzyme with a very low specific activity in vitro.

In some embodiments the hyaluronidase is a mammalian hyaluronidase. In some embodiments the hyaluronidase is a recombinant human hyaluronidase. In some embodiments, the hyaluronidase is a neutral active hyaluronidase. In some embodiments, the hyaluronidase is a neutral active soluble hyaluronidase. In some embodiments, the hyaluronidase is a recombinant PH20 neutral-active enzyme. In some embodiments, the hyaluronidase is a recombinant PH20 neutral-active soluble enzyme. In some embodiments the hyaluronidase is glycosylated. In some embodiments, the hyaluronidase possesses at least one N-linked glycan. A recombinant hyaluronidase can be produced using conventional methods known to those of skill in the art, e.g., U.S. Pat. No. 7,767,429, the entire contents of which are incorporated by reference herein.

In some embodiments the hyaluronidase is rHuPH20 (also referred to as Hylenex®; presently manufactured by Halozyme; approved by the FDA in 2005 (see e.g., Scodeller P (2014) Hyaluronidase and other Extracellular Matrix Degrading Enzymes for Cancer Therapy: New Uses and Nano-Formulations. *J Carcinog Mutage* 5:178; U.S. Pat. Nos. 7,767,429; 8,202,517; 7,431,380; 8,450,470; 8,772, 246; 8,580,252, the entire contents of each of which is incorporated by reference herein). rHuPH20 is produced by genetically engineered CHO cells containing a DNA plasmid encoding for a soluble fragment of human hyaluronidase PH20. In some embodiments the hyaluronidase is glycosylated. In some embodiments, the hyaluronidase possesses at least one N-linked glycan. A recombinant hyaluronidase can be produced using conventional methods known to those of skill in the art, e.g., U.S. Pat. No. 7,767,429, the entire contents of which are incorporated by reference herein. In some embodiments, rHuPH20 has a sequence at least 95% (e.g., at least 96%, 97%, 98%, 99%, 100%) identical to the amino acid sequence of LNFRAPPVIPNVPFLWAWNAPSEFCLGKFDE-PLDMSLFSFIGSPRINATGQGVTIFYVDRL GYY-PYIDSITGVTVNGGIPQKIS-LQDHLDKAKKDITFYMPVDNLGMAVIDWEEWRPTW ARNWKPKDVYKNRSIELVQQQNVQLSL-TEATEKAKQEFEKAGKDFLVETIKLGKLLRP NHLWGYYLFPDCYNHHYKKPGYNGSCFN-VEIKRNDDLSWLWNESTALYPSIYLNTQQS PVAAT-LYVRNRVREAIRVSKIPDAKSPLPVFAY-TRIVFTDQVLKFLSQDELVYTFGETVA LGASGIVIWGTLSIMRSMKSCLLLDNYMETILNPYI-INVTLAAKMCSQVLCQEQGVCIRK NWNSSDYLHLNPDNFAIQLEKGGKFTVRGKP-TLEDLEQFSEKFYCSCYSTLSCKEKADV KDTDAVDV-CIADGVCIDAFLKPPMETEEPQIFYNASPSTLS (SEQ ID NO: 3306).

In any of the methods provided herein, the anti-hyaluronan agent can be an agent that degrades hyaluronan or can be an agent that inhibits the synthesis of hyaluronan. For example, the anti-hyaluronan agent can be a hyaluronan degrading enzyme. In another example, the anti-hyaluronan agent or is an agent that inhibits hyaluronan synthesis. For example, the anti-hyaluronan agent is an agent that inhibits hyaluronan synthesis such as a sense or antisense nucleic acid molecule against an HA synthase or is a small molecule drug. For example, an anti-hyaluronan agent is 4-methylumbelliferone (MU) or a derivative thereof, or leflunomide or a derivative thereof. Such derivatives include, for example, a derivative of 4-methylumbelliferone (MU) that is 6,7-dihydroxy-4-methyl coumarin or 5,7-dihydroxy-4-methyl coumarin.

In further examples of the methods provided herein, the hyaluronan degrading enzyme is a hyaluronidase. In some examples, the hyaluronan-degrading enzyme is a PH20 hyaluronidase or truncated form thereof to lacking a C-terminal glycosylphosphatidylinositol (GPI) attachment site or a portion of the GPI attachment site. In specific examples, the hyaluronidase is a PH20 selected from a human, monkey, bovine, ovine, rat, mouse or guinea pig PH20. For example, the hyaluronan-degrading enzyme is a human PH20 hyaluronidase that is neutral active and N-glycosylated and is selected from among (a) a hyaluronidase polypeptide that is a full-length PH20 or is a C-terminal truncated form of the PH20, wherein the truncated form includes at least amino acid residues 36-464 of SEQ ID NO: 139, such as 36-481, 36-482, 36-483, where the full-length PH20 has the sequence of amino acids set forth in SEQ ID NO: 139; or (b) a hyaluronidase polypeptide comprising a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO: 139; or (c) a hyaluronidase polypeptide of (a) or (b) comprising amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO: 139 or the with the corresponding truncated forms thereof. In exemplary examples, the hyaluronan-degrading enzyme is a PH20 that comprises a composition designated rHuPH20.

In other examples, the anti-hyaluronan agent is a hyaluronan degrading enzyme that is modified by conjugation to a polymer. The polymer can be a PEG and the anti-hyaluronan agent a PEGylated hyaluronan degrading enzyme. Hence, in some examples of the methods provided herein the hyaluronan-degrading enzyme is modified by conjugation to a polymer. For example, the hyaluronan-degrading enzyme is conjugated to a PEG, thus the hyaluronan degrading enzyme is PEGylated. In an exemplary example, the hyaluronan-degrading enzyme is a PEGylated PH20 enzyme (PEGPH20). In the methods provided herein, the corticosteroid can be a glucocorticoid that is selected from among cortisones, dexamethasones, hydrocortisones, methylprednisolones, prednisolones and prednisones.

Chondroitinases

Chondroitinases are enzymes found throughout the animal kingdom which degrade glycosaminoglycans, specifically chondroitins and chondroitin sulfates, through an endoglycosidase reaction. In some embodiments the chondroitinase is a mammalian chondroitinase. In some embodiments the chondroitinase is a recombinant human chondroitinase. In some embodiments the chondroitinase is HYAL4. Other exemplary chondroitinases include chondroitinase ABC (derived from *Proteus vulgaris*; Japanese Patent Application Laid-open No 6-153947, T. Yamagata et al. J. Biol. Chem., 243, 1523 (1968), S. Suzuki et al, J. Biol. Chem., 243, 1543 (1968)), chondroitinase AC (derived from *Flavobacterium heparinum*; T. Yamagata et al., J. Biol. Chem., 243, 1523 (1968)), chondroitinase AC II (derived from *Arthrobacter aurescens*; K. Hiyama, and S. Okada, J. Biol. Chem., 250, 1824 (1975), K. Hiyama and S. Okada, J. Biochem. (Tokyo), 80, 1201 (1976)), Hyaluronidase ACIII (derived from *Flavobacterium* sp. Hp102; Hirofumi Miyazono et al., Seikagaku, 61, 1023 (1989)), chondroitinase B (derived from *Flavobacterium heparinum*; Y. M. Michelacci and C. P. Dietrich, Biochem. Biophys. Res. Commun., 56, 973 (1974), Y. M. Michelacci and C. P. Dietrich, Biochem. J., 151, 121 (1975), Kenichi Maeyama et al, Seikagaku, 57, 1189 (1985)), chondroitinase C (derived from *Flavobacterium* sp. Hp102; Hirofumi Miyazono et al, Seikagaku, 61, 1023 (1939)), and the like.

Matrix Metalloproteinases

Matrix metalloproteases (MMPs) are zinc-dependent endopeptidases that are the major proteases involved in extracellular matrix (ECM) degradation. MMPs are capable of degrading a wide range of extracellular molecules and a number of bioactive molecules. Twenty-four MMP genes have been identified in humans, which can be organized into six groups based on domain organization and substrate preference: Collagenases (MMP-1, -8 and -13), Gelatinases (MMP-2 and MMP-9), Stromelysins (MMP-3, -10 and -11), Matrilysin (MMP-7 and MMP-26), Membrane-type (MT)-MMPs (MMP-14, -15, -16, -17, -24 and -25) and others (MMP-12, -19, 20, -21, -23, -27 and -28). In some embodiments, the stromal modifying moiety is a human recombinant MMP (e.g., MMP-1, -2, -3, -4, -5, -6, -7, -8, -9, 10, -11, -12, -13, -14, 15, -15, -17,-18, -19, 20, -21, -22, -23, or -24).

Collagenases

The three mammalian collagenases (M1V1P-1, -8, and -13) are the principal secreted endopeptidases capable of cleaving collagenous extracellular matrix. In addition to fibrillar collagens, collagenases can cleave several other matrix and non-matrix proteins including growth factors. Collagenases are synthesized as inactive pro-forms, and once activated, their activity is inhibited by specific tissue inhibitors of metalloproteinases, TIMPs, as well as by non-specific proteinase inhibitors (Ala-aho R et al. *Biochimie*. Collagenases in cancer. 2005 March-April; 87(3-4): 273-86). In some embodiments, the stromal modifying moiety is a collagenase. In some embodiments, the collagenase is a human recombinant collagenase. In some embodiments, the collagenase is MMP-1. In some embodiments, the collagenase is MMP-8. In some embodiments, the collagenase is M1V1P-13.

Macrophage Metalloelastase

Macrophage metalloelastase (MME), also known as MMP-12, is a member of the stromelysin subgroup of MMPs and catalyzes the hydrolysis of soluble and insoluble elastin and a broad selection of matrix and nonmatrix substrates including type IV collagen, fibronectin, laminin, vitronectin, entactin, heparan, and chondroitin sulfates (Erj a Kerkela et al. Journal of Investigative Dermatology (2000) 114, 1113-1119; doi:10.1046/j.1523-1747.2000.00993). In some embodiments, the stromal modifying moiety is a MME. In some embodiments, the MME is a human recombinant MME. In some embodiments, the MME is MMP-12.

Additional Stromal Modifying Moieties

In some embodiments, the stromal modifying moiety causes one or more of: decreases the level or production of a stromal or extracellular matrix (ECM) component; decreases tumor fibrosis; increases interstitial tumor transport; improves tumor perfusion; expands the tumor microvasculature; decreases interstitial fluid pressure (IFP) in a tumor; or decreases or enhances penetration or diffusion of an agent, e.g., a cancer therapeutic or a cellular therapy, into a tumor or tumor vasculature.

In some embodiments, the stromal or ECM component decreased is chosen from a glycosaminoglycan or an extracellular protein, or a combination thereof. In some embodiments, the glycosaminoglycan is chosen from hyaluronan (also known as hyaluronic acid or HA), chondroitin sulfate, chondroitin, dermatan sulfate, heparin, heparin sulfate, entactin, tenascin, aggrecan and keratin sulfate. In some embodiments, the extracellular protein is chosen from collagen, laminin, elastin, fibrinogen, fibronectin, or vitronectin. In some embodiments, the stromal modifying moiety includes an enzyme molecule that degrades a tumor stroma or extracellular matrix (ECM). In some embodiments, the enzyme molecule is chosen from a hyaluronidase molecule, a collagenase molecule, a chondroitinase molecule, a matrix metalloproteinase molecule (e.g., macrophage metalloelastase), or a variant (e.g., a fragment) of any of the aforesaid. The term "enzyme molecule" includes a full length, a fragment or a variant of the enzyme, e.g., an enzyme variant that retains at least one functional property of the naturally-occurring enzyme.

In some embodiments, the stromal modifying moiety decreases the level or production of hyaluronic acid. In other embodiments, the stromal modifying moiety comprises a hyaluronan degrading enzyme, an agent that inhibits hyaluronan synthesis, or an antibody molecule against hyaluronic acid.

In some embodiments, the hyaluronan degrading enzyme is a hyaluronidase molecule, e.g., a full length or a variant (e.g., fragment thereof) thereof. In some embodiments, the hyaluronan degrading enzyme is active in neutral or acidic pH, e.g., pH of about 4-5. In some embodiments, the hyaluronidase molecule is a mammalian hyaluronidase molecule, e.g., a recombinant human hyaluronidase molecule, e.g., a full length or a variant (e.g., fragment thereof, e.g., a truncated form) thereof. In some embodiments, the hyaluronidase molecule is chosen from HYAL1, HYAL2, or PH-20/SPAM1, or a variant thereof (e.g., a truncated form thereof). In some embodiments, the truncated form lacks a C-terminal glycosylphosphatidylinositol (GPI) attachment site or a portion of the GPI attachment site. In some embodiments, the hyaluronidase molecule is glycosylated, e.g., comprises at least one N-linked glycan.

In some embodiments, the hyaluronidase molecule comprises the amino acid sequence: LNFRAPPVIPNVPFL-WAWNAPSEFCLGKFDEPLDMSLFSFIGSPRI-NATGQGVTIFYVDR LGYYPYIDSITGVTVNGGIPQKIS-LQDHLDKAKKDITFYMPVDNLGMAVIDWEE-WRPTW ARNWKPKDVYKNRSIELVQQQNVQLSL-TEATEKAKQEFEKAGKDFLVETIKLGKLLRP NHLWGYYLFPDCYNHHYKKPGYNGSCFN-VEIKRNDDLSWLWNESTALYPSIYLNTQQS PVAAT-LYVRNRVREAIRVSKIPDAKSPLPVFAY-TRIVFTDQVLKFLSQDELVYTFGETVA LGASGIVIWGTLSIMRSMKSCLLLDNYMETILNPYI-INVTLAAKMCSQVLCQEQGVCIRK NWNSSDYLHLNPDNFAIQLEKGGKFTVRGKP-TLEDLEQFSEKFYCSCYSTLSCKEKADV KDTDAVDV-CIADGVCIDAFLKPPMETEEPQIFYNASPSTLS (SEQ ID NO:3311), or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3311.

In some embodiments, the hyaluronidase molecule comprises:
  (i) the amino acid sequence of 36-464 of SEQ ID NO: 3311;
  (ii) the amino acid sequence of 36-481, 36-482, or 36-483 of PH20, wherein PH20 has the sequence of amino acids set forth in SEQ ID NO: 3311; or
  (iii) an amino acid sequence having at least 95% to 100% sequence identity to the polypeptide or truncated form of sequence of amino acids set forth in SEQ ID NO: 3311; or
  (iv) an amino acid sequence having 30, 20, 10, 5 or fewer amino acid substitutions to the amino acid sequence set forth in SEQ ID NO: 3311. In some embodiments, the hyaluronidase molecule comprises an amino acid sequence at least 95% (e.g., at least 95%, 96%, 97%, 98%, 99%, 100%) identical to the amino acid sequence of SEQ ID NO: 3311. In some embodiments, the hyaluronidase molecule is encoded by a nucleotide sequence at least 95% (e.g., at least 96%, 97%, 98%, 99%, 100%) identical to the nucleotide sequence of SEQ ID NO: 3311.

In some embodiments, the hyaluronidase molecule is PH20, e.g., rHuPH20. In some embodiments, the hyaluronidase molecule is HYAL1 and comprises the amino acid sequence: FRGPLLPNRPFTTVWNANTQWCLER-HGVDVDVSVFDVVANPGQTFRGPDMTIFYSSQG TYPYYTPTGEPVFGGLPQNASLIAHLARTFQDILAAI-PAPDFSGLAVIDWEAWRPRWAFN WDTKDIYRQRSRALVQAQHPDWPAPQVEAV-AQDQFQGAARAWMAGTLQLGRALRPR GLWGFYGFPDCYNYDFLSPNYTGQCPSGI-RAQNDQLGWLWGQSRALYPSIYMPAVLEG TGKSQMYVQHRVAEAFRVAVAAGDPNLPVLPYVQI-FYDTTNHFLPLDELEHSLGESAA QGAAGVVLWVS-WENTRTKESCQAIKEYMDTTLGP-FILNVTSGALLCSQALCSGHGRCV RRTSHPKALLLLNPASFSIQLTPGGGPLSLR-GALSLEDQAQMAVEFKCRCYPGWQAPWC ERKSMW (SEQ ID NO: 3312), or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3312.

In some embodiments, the hyaluronan degrading enzyme, e.g., the hyaluronidase molecule, further comprises a polymer, e.g., is conjugated to a polymer, e.g., PEG. In some embodiments, the hyaluronan-degrading enzyme is a PEGylated PH20 enzyme (PEGPH20). In some embodiments, the hyaluronan degrading enzyme, e.g., the hyaluronidase molecule, further comprises an immunoglobulin chain constant region (e.g., Fc region) chosen from, e.g., the heavy chain constant regions of IgG1, IgG2, IgG3, and IgG4, more particularly, the heavy chain constant region of human IgG1, IgG2, IgG3, or IgG4. In some embodiments, the immunoglobulin constant region (e.g., the Fc region) is linked, e.g., covalently linked to, the hyaluronan degrading enzyme, e.g., the hyaluronidase molecule. In some embodiments, the immunoglobulin chain constant region (e.g., Fc region) is altered, e.g., mutated, to increase or decrease one or more of: Fc receptor binding, antibody glycosylation, the number of cysteine residues, effector cell function, or complement function. In some embodiments, the hyaluronan degrading enzyme, e.g., the hyaluronidase molecule forms a dimer.

In some embodiments, the stromal modifying moiety comprises an inhibitor of the synthesis of hyaluronan, e.g., an HA synthase. In some embodiments, the inhibitor comprises a sense or an antisense nucleic acid molecule against an HA synthase or is a small molecule drug. In some embodiments, the inhibitor is 4-methylumbelliferone (MU) or a derivative thereof (e.g., 6,7-dihydroxy-4-methyl coumarin or 5,7-dihydroxy-4-methyl coumarin), or leflunomide or a derivative thereof.

In some embodiments, the stromal modifying moiety comprises antibody molecule against hyaluronic acid.

In some embodiments, the stromal modifying moiety comprises a collagenase molecule, e.g., a mammalian collagenase molecule, or a variant (e.g., fragment) thereof. In some embodiments, the collagenase molecule is collagenase molecule IV, e.g., comprising the amino acid sequence of:

YNFFPRKPKWDKNQITYRIIGYTPDLDPETVDDA-FARAFQVWSDVTPLRFSRIHDGEADI MINFGR-WEHGDGYPFDGKDGLLAHAFAPGTGVGGDSHFDD-DELWTLGEGQVVRVKY GNADGEYCKFPFLFNGKEYNSCTDTGRSDGFLWC-STTYNFEKDGKYGFCPHEALFTMG GNAEGQPCKFP-FRFQGTSYDSCTTEGRTDGYRWCGTTEDY-DRDKKYGFCPETAMSTVG GNSEGAPCVFPFTFLGNKYESCTSAGRSDGKMW-CATTANYDDDRKWGFCPDQGYSLF LVAA-HEFGHAMGLEHSQDPGALMAPIYTYTKNFRLSQD-DIKGIQELYGASPDIDLGTGP TPTLGPVTPEICKQDIVFDGIAQIRGE-IFFFKDRFIWRTVTPRDKPMGPLLVATFWPELPEK IDAVYEAPQEEKAVFFAGNEYWIYSASTLER-GYPKPLTSLGLPPDVQRVDAAFNWSKNK KTYIF-AGDKFWRYNEVKKKMDPGFPKLIADAWNAIPDNL-DAVVDLQGGGHSYFFKGA YYLKLENQSLKSVKFGSIKSDWLGC (SEQ ID NO: 3313), or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 3313.

Linkers

The multispecific or multifunctional molecule disclosed herein can further include a linker, e.g., a linker between one or more of: the antigen binding domain and the cytokine molecule, the antigen binding domain and the immune cell engager, the antigen binding domain and the stromal modifying moiety, the cytokine molecule and the immune cell engager, the cytokine molecule and the stromal modifying moiety, the immune cell engager and the stromal modifying moiety, the antigen binding domain and the immunoglobulin chain constant region, the cytokine molecule and the immunoglobulin chain constant region, the immune cell engager and the immunoglobulin chain constant region, or the stromal modifying moiety and the immunoglobulin chain constant region. In embodiments, the linker is chosen from: a cleavable linker, a non-cleavable linker, a peptide linker, a flexible linker, a rigid linker, a helical linker, or a non-helical linker, or a combination thereof.

In one embodiment, the multispecific molecule can include one, two, three or four linkers, e.g., a peptide linker. In one embodiment, the peptide linker includes Gly and Ser. In some embodiments, the peptide linker is selected from GGGGS (SEQ ID NO: 3307); GGGGSGGGGS (SEQ ID NO: 3308); GGGGSGGGGSGGGGS (SEQ ID NO: 3309); and DVPSGPGGGGSGGGGS (SEQ ID NO: 3310). In some embodiments, the peptide linker is a A(EAAAK)nA (SEQ ID NO: 3437) family of linkers (e.g., as described in Protein Eng. (2001) 14 (8): 529-532). These are stiff helical linkers with n ranging from 2-5. In some embodiments, the peptide linker is selected from AEAAAKEAAAKAAA (SEQ ID NO: 3314); AEAAAKEAAAKEAAAKAAA (SEQ ID NO: 3315); AEAAAKEAAAKEAAAKEAAA-KAAA (SEQ ID NO: 3316); and AEAAAKEAAAKEAAAKEAAAKAAAKAAA (SEQ ID NO: 3317).

Nucleic Acids

Nucleic acids encoding the aforementioned antibody molecules, e.g., anti-TCRβV antibody molecules, multispecific or multifunctional molecules are also disclosed.

In certain embodiments, the invention features nucleic acids comprising nucleotide sequences that encode heavy and light chain variable regions and CDRs or hypervariable loops of the antibody molecules, as described herein. For example, the invention features a first and second nucleic acid encoding heavy and light chain variable regions, respectively, of an antibody molecule chosen from one or more of the antibody molecules disclosed herein. The nucleic acid can comprise a nucleotide sequence as set forth in the tables herein, or a sequence substantially identical thereto (e.g., a sequence at least about 85%, 90%, 95%, 99% or more identical thereto, or which differs by no more than 3, 6, 15, 30, or 45 nucleotides from the sequences shown in the tables herein.

In certain embodiments, the nucleic acid can comprise a nucleotide sequence encoding at least one, two, or three CDRs or hypervariable loops from a heavy chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In other embodiments, the nucleic acid can comprise a nucleotide sequence encoding at least one, two, or three CDRs or hypervariable loops from a light chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In yet another embodiment, the nucleic acid can comprise a nucleotide sequence encoding at least one, two, three, four, five, or six CDRs or hypervariable loops from heavy and light chain variable regions having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions).

In certain embodiments, the nucleic acid can comprise a nucleotide sequence encoding at least one, two, or three CDRs or hypervariable loops from a heavy chain variable region having the nucleotide sequence as set forth in the tables herein, a sequence substantially homologous thereto (e.g., a sequence at least about 85%, 90%, 95%, 99% or more identical thereto, and/or capable of hybridizing under the stringency conditions described herein). In another embodiment, the nucleic acid can comprise a nucleotide sequence encoding at least one, two, or three CDRs or hypervariable loops from a light chain variable region having the nucleotide sequence as set forth in the tables herein, or a sequence substantially homologous thereto (e.g., a sequence at least about 85%, 90%, 95%, 99% or more identical thereto, and/or capable of hybridizing under the stringency conditions described herein). In yet another embodiment, the nucleic acid can comprise a nucleotide sequence encoding at least one, two, three, four, five, or six CDRs or hypervariable loops from heavy and light chain variable regions having the nucleotide sequence as set forth in the tables herein, or a sequence substantially homologous thereto (e.g., a sequence at least about 85%, 90%, 95%, 99% or more identical thereto, and/or capable of hybridizing under the stringency conditions described herein).

In certain embodiments, the nucleic acid can comprise a nucleotide sequence encoding a cytokine molecule, an immune cell engager, or a stromal modifying moiety disclosed herein.

In another aspect, the application features host cells and vectors containing the nucleic acids described herein. The nucleic acids may be present in a single vector or separate vectors present in the same host cell or separate host cell, as described in more detail hereinbelow.

Vectors

Further provided herein are vectors comprising the nucleotide sequences encoding antibody molecules, e.g., anti-TCRβV antibody molecules, or a multispecific or multifunctional molecule described herein. In one embodiment, the vectors comprise nucleic acid sequences encoding antibody molecules, e.g., anti-TCRβV antibody molecules, or multispecific or multifunctional molecule described herein. In one embodiment, the vectors comprise the nucleotide sequences described herein. The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes may be selected by introducing one or more markers which allow for the selection of transfected host cells. The marker may provide, for example, prototropy to an auxotrophic host, biocide resistance (e.g., antibiotics), or resistance to heavy metals such as copper, or the like. The selectable marker gene can be either directly linked to the DNA sequences to be expressed, or introduced into the same cell by cotransformation. Additional elements may also be needed for optimal synthesis of mRNA. These elements may include splice signals, as well as transcriptional promoters, enhancers, and termination signals.

Once the expression vector or DNA sequence containing the constructs has been prepared for expression, the expression vectors may be transfected or introduced into an appropriate host cell. Various techniques may be employed to achieve this, such as, for example, protoplast fusion, calcium phosphate precipitation, electroporation, retroviral transduction, viral transfection, gene gun, lipid based transfection or other conventional techniques. In the case of protoplast fusion, the cells are grown in media and screened for the appropriate activity.

Methods and conditions for culturing the resulting transfected cells and for recovering the antibody molecule produced are known to those skilled in the art, and may be varied or optimized depending upon the specific expression vector and mammalian host cell employed, based upon the present description.

Cells

In another aspect, the application features host cells and vectors containing the nucleic acids described herein. The nucleic acids may be present in a single vector or separate vectors present in the same host cell or separate host cell. The host cell can be a eukaryotic cell, e.g., a mammalian cell, an insect cell, a yeast cell, or a prokaryotic cell, e.g., *E. coli*. For example, the mammalian cell can be a cultured cell or a cell line. Exemplary mammalian cells include lymphocytic cell lines (e.g., NSO), Chinese hamster ovary cells (CHO), COS cells, oocyte cells, and cells from a transgenic animal, e.g., mammary epithelial cell.

The invention also provides host cells comprising a nucleic acid encoding an antibody molecule as described herein.

In one embodiment, the host cells are genetically engineered to comprise nucleic acids encoding the antibody molecule.

In one embodiment, the host cells are genetically engineered by using an expression cassette. The phrase "expression cassette," refers to nucleotide sequences, which are capable of affecting expression of a gene in hosts compatible with such sequences. Such cassettes may include a promoter, an open reading frame with or without introns, and a termination signal. Additional factors necessary or helpful in effecting expression may also be used, such as, for example, an inducible promoter.

The invention also provides host cells comprising the vectors described herein.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

Method of Expanding Cells with Anti-TCRVB Antibodies

Any of the compositions and methods described herein can be used to expand an immune cell population. An immune cell provided herein includes an immune cell derived from a hematopoietic stem cell or an immune cell derived from a non-hematopoietic stem cell, e.g., by differentiation or de-differentiation.

An immune cell includes a hematopoietic stem cell, progeny thereof and/or cells that have differentiated from said HSC, e.g., lymphoid cells or myeloid cells. An immune cell can be an adaptive immune cell or an innate immune cell. Examples of immune cells include T cells, B cells, Natural Killer cells, Natural Killer T cells, neutrophils, dendritic cells, monocytes, macrophages, and granulocytes.

In some embodiments of any of the methods of compositions disclosed herein, an immune cell is a T cell. In some embodiments, a T cell includes a CD4+ T cell, a CD8+ T cell, a TCR alpha-beta T cell, a TCR gamma-delta T cell. In some embodiments, a T cell comprises a memory T cell (e.g., a central memory T cell, or an effector memory T cell (e.g., a TEMRA) or an effector T cell. In some embodiments, a T cell comprises a tumor infiltrating lymphocyte (TIL).

In some embodiments of any of the methods of compositions disclosed herein, an immune cell is an NK cell.

In some embodiments of any of the methods of compositions disclosed herein, an immune cell is a TIL. TILs are immune cells (e.g., T cells, B cells or NK cells) that can be found in a tumor or around a tumor (e.g., in the stroma or tumor microenvironment of a tumor), e.g., a solid tumor, e.g., as described herein. TILs can be obtained from a sample from a subject having cancer, e.g., a biopsy or a surgical sample. In some embodiments, TILs can be expanded using a method disclosed herein. In some embodiments, a population of expanded TILs, e.g., expanded using a method disclosed herein, can be administered to a subject to treat a disease, e.g., a cancer.

In certain aspects of the present disclosure, immune cells, e.g., T cells (e.g., TILs), can be obtained from a unit of blood collected from a subject using any number of techniques known to the skilled artisan, such as Ficoll™ separation. In one aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations. The methods described herein can include more than one selection step, e.g., more than one depletion step.

In one embodiment, the methods of the application can utilize culture media conditions comprising DMEM, DMEM F12, RPMI 1640, and/or AIM V media. The media can be supplemented with glutamine, HEPES buffer (e.g., 10 mM), serum (e.g., heat-inactivated serum, e.g., 10%), and/or beta mercaptoethanol (e.g., 55 uM). IN some embodiments, the culture conditions disclosed herein comprise one or more supplements, cytokines, growth factors, or hormones. In some embodiments, the culture condition comprises one or more of IL-2, IL-15, or IL-7, or a combination thereof.

Immune effector cells such as T cells may be activated and expanded generally using methods as described, for example, in U.S. Pat. Nos. 6,352,694; 6,534,055; or 6,905,680. Generally, a population of immune cells, may be expanded by contact with an agent that stimulates a CD3/TCR complex associated signal and a ligand that stimulates a costimulatory molecule on the surface of the T cells; and/or by contact with a cytokine, e.g., IL-2, IL-15 or IL-7. T cell expansion protocols can also include stimulation, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2): 53-63, 1999).

A TIL population can also be expanded by methods known in the art. For example, a population of TILs can be expanded as described in Hall et al., *Journal for Immuno Therapy of Cancer* (2016) 4:61, the entire contents of which are hereby incorporated by reference. Briefly, TILs can be isolated from a sample by mechanical and/or physical digestion. The resultant TIL population can be stimulated with an anti-CD3 antibody in the presence of non-dividing feeder cells. In some embodiments, the TIL population can be cultured, e.g., expanded, in the presence of IL-2, e.g., human IL-2. In some embodiments, the TIL cells can be cultured, e.g., expanded for a period of at least 1-21 days, e.g., at least 1, 2, 3, 4, 5, 6, 7, 8, 9, 10, 11, 12, 13, 14, 15, 16, 17, 18, 19, 20 or 21 days.

As disclosed herein, in some embodiments, an immune cell population (e.g., a T cell (e.g., a $T_{EMRA}$ cell or a TIL population) can be expanded by contacting the immune cell population with an anti-TCRVB antibody, e.g., as described herein.

In some embodiments, the expansion occurs in vivo, e.g., in a subject. In some embodiments, a subject is administered an anti-TCRβV antibody molecule disclosed herein resulting in expansion of immune cells in vivo.

In some embodiments, the expansion occurs ex vivo, e.g., in vitro. In some embodiments, cells from a subject, e.g., T cells, e.g., TIL cells, are expanded in vitro with an anti- TCRβV antibody molecule disclosed herein. In some embodiments, the expanded TILs are administered to the subject to treat a disease or a symptom of a disease.

In some embodiments, a method of expansion disclosed herein results in an expansion of at least 1.1-10 fold, 10-20 fold, or 20-50 fold expansion. In some embodiments, the expansion is at least 1.1, 1.2, 1.3, 1.4, 1.5, 2, 3, 4, 5, 6, 7, 8, 9, 10, 15, 20, 25, 30, 35, 40, 45 or 50 fold expansion.

In some embodiments, a method of expansion disclosed herein comprises culturing, e.g., expanding, the cells for at least about 4 hours, 6 hours, 10 hours, 12 hours, 15 hours, 18 hours, 20 hours, or 22 hours. In some embodiments, a method of expansion disclosed herein comprises culturing, e.g., expanding, the cells for at least 1, 2, 3, 4, 5, 6, 7, 8, 9, 10, 11, 12, 13, 14, 15, 16, 17, 18, 19, 20 or 21 days. In some embodiments, a method of expansion disclosed herein comprises culturing, e.g., expanding, the cells for at least about 1 week, 2 weeks, 3 weeks, 4 weeks, 5 weeks, 6 weeks, 7 weeks or 8 weeks.

In some embodiments, a method of expansion disclosed herein is performed on immune cells obtained from a healthy subject.

In some embodiments, a method of expansion disclosed herein is performed on immune cells (e.g., TILs) obtained from a subject having a disease, e.g., a cancer, e.g., a solid tumor as disclosed herein.

In some embodiments, a method of expansion disclosed herein further comprises contacting the population of cells with an agent, that promotes, e.g., increases, immune cell expansion. In some embodiments, the agent comprises an immune checkpoint inhibitor, e.g., a PD-1 inhibitor, a LAG-3 inhibitor, a CTLA4 inhibitor, or a TIM-3 inhibitor. In some embodiments, the agent comprises a 4-1BB agonist, e.g., an anti-4-1BB antibody.

Without wishing to be bound by theory, it is believed that an anti-TCRβV antibody molecule disclosed herein can expand, e.g., selectively or preferentially expand, T cells expressing a T cell receptor (TCR) comprising a TCR alpha and/or TCR beta molecule, e.g., TCR alpha-beta T cells (αβ T cells). In some embodiments, an anti-TCRβV antibody molecule disclosed herein does not expand, or induce proliferation of T cells expressing a TCR comprising a TCR gamma and/or TCR delta molecule, e.g., TCR gamma-delta T cells (γδ T cells). In some embodiments, an anti-TCRβV antibody molecule disclosed herein, selectively or preferentially expands αβ T cells over γδ T cells.

Without wishing to be bound by theory, it is believed that, in some embodiments, γδ T cells are associated with cytokine release syndrome (CRS) and/or neurotoxicity (NT). In some embodiments, an anti-TCRβV antibody molecule disclosed herein results in selective expansion of non-γδ T cells, e.g., expansion of αβ T cells, thus reducing CRS and/or NT.

In some embodiments, any of the compositions or methods disclosed herein result in an immune cell population having a reduction of, e.g., depletion of, γδ T cells. In some embodiments, the immune cell population is contacted with an agent that reduces, e.g., inhibits or depletes, γδ T cells, e.g., an anti-IL-17 antibody or an agent that binds to a TCR gamma and/or TCR delta molecule.

Uses and Combination Therapies

Methods described herein include treating a cancer in a subject by using an anti-TCRβV antibody molecule, a multispecific or multifunctional molecule described herein, e.g., using a pharmaceutical composition described herein. Also provided are methods for reducing or ameliorating a symptom of a cancer in a subject, as well as methods for inhibiting the growth of a cancer and/or killing one or more cancer cells. In embodiments, the methods described herein decrease the size of a tumor and/or decrease the number of cancer cells in a subject administered with a described herein or a pharmaceutical composition described herein.

In embodiments, the cancer is a hematological cancer. In embodiments, the hematological cancer is a leukemia or a lymphoma. As used herein, a "hematologic cancer" refers to a tumor of the hematopoietic or lymphoid tissues, e.g., a tumor that affects blood, bone marrow, or lymph nodes. Exemplary hematologic malignancies include, but are not limited to, leukemia (e.g., acute lymphoblastic leukemia (ALL), acute myeloid leukemia (AML), chronic lymphocytic leukemia (CLL), chronic myelogenous leukemia (CIVIL), hairy cell leukemia, acute monocytic leukemia (AMoL), chronic myelomonocytic leukemia (CMML), juvenile myelomonocytic leukemia (JMML), or large granular lymphocytic leukemia), lymphoma (e.g., AIDS-related lymphoma, cutaneous T-cell lymphoma, Hodgkin lymphoma (e.g., classical Hodgkin lymphoma or nodular lymphocyte-predominant Hodgkin lymphoma), mycosis fungoides, non-Hodgkin lymphoma (e.g., B-cell non-Hodgkin lymphoma (e.g., Burkitt lymphoma, small lymphocytic lymphoma (CLL/SLL), diffuse large B-cell lymphoma, follicular lymphoma, immunoblastic large cell lymphoma, precursor B-lymphoblastic lymphoma, or mantle cell lymphoma) or T-cell non-Hodgkin lymphoma (mycosis fungoides, anaplastic large cell lymphoma, or precursor T-lymphoblastic lymphoma)), primary central nervous system lymphoma, Sezary syndrome, Waldenstrom macroglobulinemia), chronic myeloproliferative neoplasm, Langerhans cell histiocytosis, multiple myeloma/plasma cell neoplasm, myelodysplastic syndrome, or myelodysplastic/myeloproliferative neoplasm.

In embodiments, the cancer is a myeloproliferative neoplasm, e.g., primary or idiopathic myelofibrosis (MF), essential thrombocytosis (ET), polycythemia vera (PV), or chronic myelogenous leukemia (CIVIL). In embodiments, the cancer is myelofibrosis. In embodiments, the subject has myelofibrosis. In embodiments, the subject has a calreticulin mutation, e.g., a calreticulin mutation disclosed herein. In embodiments, the subject does not have the JAK2-V617F mutation. In embodiments, the subject has the JAK2-V617F mutation. In embodiments, the subject has a MPL mutation. In embodiments, the subject does not have a MPL mutation.

In embodiments, the cancer is a solid cancer. Exemplary solid cancers include, but are not limited to, ovarian cancer, rectal cancer, stomach cancer, testicular cancer, cancer of the anal region, uterine cancer, colon cancer, rectal cancer, renal-cell carcinoma, liver cancer, non-small cell carcinoma of the lung, cancer of the small intestine, cancer of the esophagus, melanoma, Kaposi's sarcoma, cancer of the endocrine system, cancer of the thyroid gland, cancer of the parathyroid gland, cancer of the adrenal gland, bone cancer, pancreatic cancer, skin cancer, cancer of the head or neck, cutaneous or intraocular malignant melanoma, uterine cancer, brain stem glioma, pituitary adenoma, epidermoid cancer, carcinoma of the cervix squamous cell cancer, carcinoma of the fallopian tubes, carcinoma of the endometrium, carcinoma of the vagina, sarcoma of soft tissue, cancer of the urethra, carcinoma of the vulva, cancer of the penis, cancer of the bladder, cancer of the kidney or ureter, carcinoma of the renal pelvis, spinal axis tumor, neoplasm of the central nervous system (CNS), primary CNS lymphoma, tumor angiogenesis, metastatic lesions of said cancers, or combinations thereof.

In embodiments, the anti-TCRβV antibody molecule, multispecific or multifunctional molecules (or pharmaceutical composition) are administered in a manner appropriate to the disease to be treated or prevented. The quantity and frequency of administration will be determined by such factors as the condition of the patient, and the type and severity of the patient's disease. Appropriate dosages may be determined by clinical trials. For example, when "an effective amount" or "a therapeutic amount" is indicated, the precise amount of the pharmaceutical composition (or multispecific or multifunctional molecules) to be administered can be determined by a physician with consideration of individual differences in tumor size, extent of infection or metastasis, age, weight, and condition of the subject. In embodiments, the pharmaceutical composition described herein can be administered at a dosage of $10^4$ to $10^9$ cells/kg body weight, e.g., $10^5$ to $10^6$ cells/kg body weight, including all integer values within those ranges. In embodiments, the pharmaceutical composition described herein can be administered multiple times at these dosages. In embodiments, the pharmaceutical composition described herein can be administered using infusion techniques described in immunotherapy (see, e.g., Rosenberg et al., New Eng. J. of Med. 319:1676, 1988).

In embodiments, the anti-TCRβV antibody molecule, multispecific or multifunctional molecules or pharmaceutical composition is administered to the subject parentally. In embodiments, the cells are administered to the subject intravenously, subcutaneously, intratumorally, intranodally, intramuscularly, intradermally, or intraperitoneally. In embodiments, the cells are administered, e.g., injected, directly into a tumor or lymph node. In embodiments, the cells are administered as an infusion (e.g., as described in Rosenberg et al., New Eng. J. of Med. 319:1676, 1988) or an intravenous push. In embodiments, the cells are administered as an injectable depot formulation.

In embodiments, the subject is a mammal. In embodiments, the subject is a human, monkey, pig, dog, cat, cow, sheep, goat, rabbit, rat, or mouse. In embodiments, the subject is a human. In embodiments, the subject is a pediatric subject, e.g., less than 18 years of age, e.g., less than 17, 16, 15, 14, 13, 12, 11, 10, 9, 8, 7, 6, 5, 4, 3, 2, 1 or less years of age. In embodiments, the subject is an adult, e.g., at least 18 years of age, e.g., at least 19, 20, 21, 22, 23, 24, 25, 25-30, 30-35, 35-40, 40-50, 50-60, 60-70, 70-80, or 80-90 years of age.

Methods of Cancer Treatment Methods described herein include treating a cancer in a subject by using an anti-TCRβV antibody molecule, e.g., using a pharmaceutical composition described herein. Also provided are methods for reducing or ameliorating a symptom of a cancer in a subject, as well as methods for inhibiting the growth of a cancer and/or killing one or more cancer cells. In embodiments, the methods described herein decrease the size of a tumor and/or decrease the number of cancer cells in a subject administered with a described herein or a pharmaceutical composition described herein.

Disclosed herein are methods of treating a subject having a cancer comprising acquiring a status of one or more TCRBV molecules in a subject. In some embodiments, a higher, e.g., increased, level or activity of one or more TCRβV molecules in a subject, e.g., in a sample from a subject, is indicative of a bias, e.g., a preferential expansion, e.g., clonal expansion, of T cells expressing said one or more TCRβV molecules in the subject.

Without wishing to be bound by theory, it is believed that a biased T cell population, e.g., a T cell population expressing a TCRβV molecule, is antigen-specific for a disease antigen, e.g., a cancer antigen (Wang C Y, et al., Int J Oncol. (2016) 48(6):2247-56). In some embodiments, the cancer antigen comprises a cancer associated antigen or a neoantigen. In some embodiments, a subject having a cancer, e.g., as disclosed herein, has a higher, e.g., increased, level or activity of one or more TCRβV molecules associated with the cancer. In some embodiments, the TCRβV molecule is associated with, e.g., recognizes, a cancer antigen, e.g., a cancer associated antigen or a neoantigen.

Accordingly, disclosed herein are methods of expanding an immune effector cell population obtained from a subject, comprising acquiring a status of one or more TCRβV molecules in a sample from the subject, comprising contacting said immune effector cell population with an anti-TCRβV antibody molecule disclosed herein, e.g., an anti-TCRβV antibody molecule that binds to the same TCRβV molecule that is higher, e.g., increased in the immune effector cell population in the sample from the subject. In some embodiments, contacting the population of immune effector cells (e.g., comprising T cells that express one or more TCRβV molecules) with an anti-TCRβV molecule results in expansion of the population of immune effector cells expressing one or more TCRβV molecules. In some embodiments, the expanded population, or a portion thereof, is administered to the subject (e.g., same subject from whom the immune effector cell population was obtained), to treat the cancer. In some embodiments, the expanded population, or a portion thereof, is administered to a different subject (e.g., not the same subject from whom the immune effector cell population was obtained), to treat the cancer.

Also disclosed herein, are methods of treating a subject having a cancer, comprising: acquiring a status of one or more TCRβV molecules in a sample from the subject, and determining whether the one or more TCRβV molecules is higher, e.g., increased, in a sample from the subject compared to a reference value, wherein responsive to said determination, administering to the subject an effective amount of an anti-TCRβV antibody molecule, e.g., an agonistic anti-TCRβV antibody molecule, e.g., as described herein.

In some embodiments of any of the methods or composition for use disclosed herein, the subject has B-CLL. In some embodiments, a subject having B-CLL has a higher, e.g., increased, level or activity of one or more TCRβV molecules, e.g., one or more TCRβV molecules comprising: (i) TCRβ V6 subfamily comprising, e.g., TCRβ V6-4*01, TCRβ V6-4*02, TCRβV6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01; (ii) TCRβ V5 subfamily comprising TCRβ V5-6*01, TCRβV5-4*01, or TCRβ V5-8*01; (iii) TCRβ V3 subfamily comprising TCRβ V3-1*01; (iv) TCRβV2 subfamily comprising TCRβ V2*01; or (v) TCRβ V19 subfamily comprising TCRβ V19*01, or TCRβ V19*02.

In some embodiments, a subject having B-CLL has a higher, e.g., increased, level or activity of a TCRβ V6 subfamily comprising, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβV6-3*01 or TCRβ V6-1*01. In some embodiments, the subject is administered an anti-TCRβV molecule (e.g., an agonistic anti-TCRβV molecule as described herein) that binds to one or more members of the TCRβ V6 subfamily. In some embodiments, administration of the an anti-TCRβV molecule results in expansion of immune cells expressing one or more members of the TCRβ V6 subfamily.

In some embodiments, a subject having B-CLL has a higher, e.g., increased, level or activity of a TCRβ V5 subfamily comprising TCRβ V5-6*01, TCRβ V5-4*01, or TCRβ V5-8*01. In some embodiments, the subject is administered an anti-TCRβV molecule (e.g., an agonistic anti-TCRβV molecule as described herein) that binds to one or more members of the TCRβ V5 subfamily. In some embodiments, administration of the an anti-TCRβV molecule results in expansion of immune cells expressing one or more members of the TCRβ V5 subfamily.

In some embodiments, a subject having B-CLL has a higher, e.g., increased, level or activity of a TCRβ V3 subfamily comprising TCRβ V3-1*01. In some embodiments, the subject is administered an anti-TCRβV molecule (e.g., an agonistic anti-TCRβV molecule as described herein) that binds to one or more members of the TCRβ V3 subfamily. In some embodiments, administration of the an anti-TCRβV molecule results in expansion of immune cells expressing one or more members of the TCRβ V3 subfamily.

In some embodiments, a subject having B-CLL has a higher, e.g., increased, level or activity of a TCRβ V2 subfamily comprising TCRβ V2*01. In some embodiments, the subject is administered an anti-TCRβV molecule (e.g., an agonistic anti-TCRβV molecule as described herein) that binds to one or more members of the TCRβ V2 subfamily. In some embodiments, administration of the an anti-TCRβV molecule results in expansion of immune cells expressing one or more members of the TCRβ V2 subfamily.

In some embodiments, a subject having B-CLL has a higher, e.g., increased, level or activity of a TCRβ V19 subfamily comprising TCRβ V19*01, or TCRβ V19*02. In some embodiments, the subject is administered an anti-TCRβV molecule (e.g., an agonistic anti-TCRBV molecule as described herein) that binds to one or more members of the TCRβ V19 subfamily. In some embodiments, administration of the an anti-TCRβV molecule results in expansion of immune cells expressing one or more members of the TCRβ V19 subfamily.

In some embodiments of any of the methods or composition for use disclosed herein, the subject has melanoma. In some embodiments, a subject having melanoma has a higher, e.g., increased, level or activity of one or more TCRβV molecules, e.g., one or more TCRβV molecules comprising the TCRβ V6 subfamily comprising, e.g., TCRβ V6-4*01, TCRβ V6-4*02, TCRβ V6-9*01, TCRβ V6-8*01, TCRβ V6-5*01, TCRβ V6-6*02, TCRβ V6-6*01, TCRβV6-2*01, TCRβ V6-3*01 or TCRβ V6-1*01. In some embodiments, the subject is administered an anti-TCRβV molecule (e.g., an agonistic anti-TCRβV molecule as described herein) that binds to one or more members of the TCRβ V6 subfamily. In some embodiments, administration of the an anti-TCRβV molecule results in expansion of immune cells expressing one or more members of the TCRβ V6 subfamily.

In some embodiments of any of the methods or composition for use disclosed herein, the subject has DLBCL. In some embodiments, a subject having melanoma has a higher, e.g., increased, level or activity of one or more TCRβV molecules, e.g., one or more TCRβV molecules comprising: (i) TCRβ V13 subfamily comprising TCRβ V13*01; (ii) TCRβ V3 subfamily comprising TCRβ V3-1*01; or (iii) TCRβ V23 subfamily.

In some embodiments, a subject having DLBCL has a higher, e.g., increased, level or activity of a TCRβ V13 subfamily comprising TCRβ V 13*01. In some embodiments, the subject is administered an anti-TCRβV molecule (e.g., an agonistic anti-TCRβV molecule as described herein) that binds to one or more members of the TCRβ V13 subfamily. In some embodiments, administration of the an anti-TCRβV molecule results in expansion of immune cells expressing one or more members of the TCRβ V13 subfamily.

In some embodiments, a subject having DLBCL has a higher, e.g., increased, level or activity of a TCRβ V3 subfamily comprising TCRβ V3-1*01. In some embodiments, the subject is administered an anti-TCRβV molecule (e.g., an agonistic anti-TCRβV molecule as described herein) that binds to one or more members of the TCRβ V3 subfamily. In some embodiments, administration of the an anti-TCRβV molecule results in expansion of immune cells expressing one or more members of the TCRβ V3 subfamily.

In some embodiments, a subject having DLBCL has a higher, e.g., increased, level or activity of a TCRβ V23 subfamily. In some embodiments, the subject is administered an anti-TCRβV molecule (e.g., an agonistic anti-TCRβV molecule as described herein) that binds to one or more members of the TCRβ V23 subfamily. In some embodiments, administration of the an anti-TCRβV molecule results in expansion of immune cells expressing one or more members of the TCRβ V23 subfamily.

In some embodiments of any of the methods or composition for use disclosed herein, the subject has CRC. In some embodiments, a subject having melanoma has a higher, e.g., increased, level or activity of one or more TCRβV molecules, e.g., one or more TCRβV molecules comprising: (i) TCRβ V19 subfamily comprising TCRβ V19*01, or TCRβ V19*02; (ii) TCRβ V12 subfamily comprising TCRβ V 12-4*O 1, TCRβ V 12-3*01, or TCRβ V 12-5*01; (iii) TCRβ V16 subfamily comprising TCRβ V16*01; or (iv) TCRβ V21 subfamily.

In some embodiments, a subject having CRC has a higher, e.g., increased, level or activity of a TCRβ V19 subfamily comprising TCRβ V19*01, or TCRβ V19*02. In some embodiments, the subject is administered an anti-TCRβV molecule (e.g., an agonistic anti-TCRβV molecule as described herein) that binds to one or more members of the TCRβ V19 subfamily. In some embodiments, administration of the an anti-TCRβV molecule results in expansion of immune cells expressing one or more members of the TCRβ V19 subfamily.

In some embodiments, a subject having CRC has a higher, e.g., increased, level or activity of a TCRβ V12 subfamily comprising TCRβ V12-4*01, TCRβ V12-3*01, or TCRβV12-5*01. In some embodiments, the subject is administered an anti-TCRβV molecule (e.g., an agonistic anti-TCRβV molecule as described herein) that binds to one or more members of the TCRβ V12 subfamily. In some embodiments, administration of the an anti-TCRβV molecule results in expansion of immune cells expressing one or more members of the TCRβ V12 subfamily.

In some embodiments, a subject having CRC has a higher, e.g., increased, level or activity of a TCRβ V16 subfamily comprising TCRβ V16*01. In some embodiments, the subject is administered an anti-TCRβV molecule (e.g., an agonistic anti-TCRβV molecule as described herein) that binds to one or more members of the TCRβ V16 subfamily. In some embodiments, administration of the an anti-TCRβV molecule results in expansion of immune cells expressing one or more members of the TCRβ V16 subfamily.

In some embodiments, a subject having CRC has a higher, e.g., increased, level or activity of a TCRβ V21 subfamily. In some embodiments, the subject is administered an anti-TCRβV molecule (e.g., an agonistic anti-TCRβV molecule as described herein) that binds to one or more members of the TCRβ V21 subfamily. In some embodiments, administration of the an anti-TCRβV molecule results in expansion of immune cells expressing one or more members of the TCRβ V21 subfamily.

In some embodiments, acquiring a value for the status, e.g., presence, level and/or activity, of one or more TCRβV molecules comprises acquiring a measure of the T cell receptor (TCR) repertoire of a sample. In some embodiments, the value comprises a measure of the clonotype of a population of T cells in the sample.

In some embodiments, a value for the status of one or more TCRβV molecules is obtained, e.g., measured, using an assay described in Wang C Y, et al., *Int J Oncol*. (2016) 48(6):2247-56, the entire contents of which are hereby incorporated by reference.

In some embodiments, a value for the status of one or more TCRβV molecules is obtained, e.g., measured, using flow cytometry.

Combination Therapies

The anti-TCRβV antibody molecule, multispecific or multifunctional molecules disclosed herein can be used in combination with a second therapeutic agent or procedure.

In embodiments, the anti-TCRβV antibody molecule, multispecific or multifunctional molecule and the second therapeutic agent or procedure are administered/performed after a subject has been diagnosed with a cancer, e.g., before the cancer has been eliminated from the subject. In embodiments, the anti-TCRβV antibody molecule, multispecific or multifunctional molecule and the second therapeutic agent or procedure are administered/performed simultaneously or concurrently. For example, the delivery of one treatment is still occurring when the delivery of the second commences, e.g., there is an overlap in administration of the treatments. In other embodiments, the anti-TCRβV antibody molecule, multispecific or multifunctional molecule and the second therapeutic agent or procedure are administered/performed sequentially. For example, the delivery of one treatment ceases before the delivery of the other treatment begins.

In embodiments, combination therapy can lead to more effective treatment than monotherapy with either agent alone. In embodiments, the combination of the first and second treatment is more effective (e.g., leads to a greater reduction in symptoms and/or cancer cells) than the first or second treatment alone. In embodiments, the combination therapy permits use of a lower dose of the first or the second treatment compared to the dose of the first or second treatment normally required to achieve similar effects when administered as a monotherapy. In embodiments, the combination therapy has a partially additive effect, wholly additive effect, or greater than additive effect.

In one embodiment, the anti-TCRBV antibody, multispecific or multifunctional molecule is administered in combination with a therapy, e.g., a cancer therapy (e.g., one or more of anti cancer agents, immunotherapy, photodynamic therapy (PDT), surgery and/or radiation). The terms "chemotherapeutic," "chemotherapeutic agent," and "anti-cancer agent" are used interchangeably herein. The administration of the multispecific or multifunctional molecule and the therapy, e.g., the cancer therapy, can be sequential (with or without overlap) or simultaneous. Administration of the anti-TCRBV antibody, multispecific or multifunctional molecule can be continuous or intermittent during the course of therapy (e.g., cancer therapy). Certain therapies described herein can be used to treat cancers and non-cancerous diseases. For example, PDT efficacy can be enhanced in cancerous and non-cancerous conditions (e.g., tuberculosis) using the methods and compositions described herein (reviewed in, e.g., Agostinis, P. et al. (2011) *CA Cancer J. Clin.* 61:250-281).

Anti-Cancer Therapies

In other embodiments, the anti-TCRβV antibody molecule, multispecific or multifunctional molecule is administered in combination with a low or small molecular weight chemotherapeutic agent. Exemplary low or small molecular weight chemotherapeutic agents include, but not limited to, 13-cis-retinoic acid (isotretinoin, ACCUTANE®), 2-CdA (2-chlorodeoxyadenosine, cladribine, LEUSTATIN™), 5-azacitidine (azacitidine, VIDAZA®), 5 fluorouracil (5-FU, fluorouracil, ADRUCIL®), 6-mercaptopurine (6-MP, mercaptopurine, PURINETHOL®), 6-TG (6-thioguanine, thioguanine, THIOGUANINE TABLOID®), abraxane (paclitaxel protein-bound), actinomycin-D (dactinomycin, COSMEGEN®), alitretinoin (PANRETIN®), all-transretinoic acid (ATRA, tretinoin, VESANOID®), altretamine (hexamethylmelamine, HMM, HEXALEN®), amethopterin (methotrexate, methotrexate sodium, MTX, TREXALL™, RHEUMATREX®), amifostine (ETHYOL®), arabinosylcytosine (Ara-C, cytarabine, CYTOSAR-U®), arsenic trioxide (TRISENOX®), asparaginase (*Erwinia* L-asparaginase, L-asparaginase, ELSPAR®, KIDROLASE®), BCNU (carmustine, BiCNU®), bendamustine (TREANDA®), bexarotene (TARGRETIN®), bleomycin (BLENOXANE®), busulfan (BUSULFEX®, MYLERAN®), calcium leucovorin (Citrovorum Factor, folinic acid, leucovorin), camptothecin-11 (CPT-11, irinotecan, CAMPTOSAR®), capecitabine (XELODA®), carboplatin (PARAPLATIN®), carmustine wafer (prolifeprospan 20 with carmustine implant, GLIADEL® wafer), CCI-779 (temsirolimus, TORISEL®), CCNU (lomustine, CeeNU), CDDP (cisplatin, PLATINOL®, PLATINOL-AQ®), chlorambucil (leukeran), cyclophosphamide (CYTOXAN®, NEOSAR®), dacarbazine (DIC, DTIC, imidazole carboxamide, DTIC-DOME®), daunomycin (daunorubicin, daunorubicin hydrochloride, rubidomycin hydrochloride, CERUBIDINE®), decitabine (DACOGEN®), dexrazoxane (ZINECARD®), DHAD (mitoxantrone, NOVANTRONE®), docetaxel (TAXOTERE®), doxorubicin (ADRIAMYCIN®, RUBEX®), epirubicin (ELLENCE™), estramustine (EMCYT®), etoposide (VP-16, etoposide phosphate, TOPOSAR®, VEPESID®, ETOPOPHOS®), floxuridine (FUDR®), fludarabine (FLUDARA®), fluorouracil (cream) (CARAC™, EFUDEX®, FLUOROPLEX®), gemcitabine (GEMZAR®), hydroxyurea (HYDREA®, DROXIA™, MYLOCEL™), idarubicin (IDAMYCIN®), ifosfamide (IFEX®), ixabepilone (IXEMPRA™), LCR (leurocristine, vincristine, VCR, ONCOVIN®, VINCASAR PFS®), L-PAM (L-sarcolysin, melphalan, phenylalanine mustard, ALKERAN®), mechlorethamine (mechlorethamine hydrochloride, mustine, nitrogen mustard, MUSTARGEN®), mesna (MESNEX™), mitomycin (mitomycin-C, MTC, MUTAMYCIN®), nelarabine (ARRANON®), oxaliplatin (ELOXATIN™), paclitaxel (TAXOL®, ONXAL™) pegaspargase (PEG-L-asparaginase, ONCOSPAR®), PEMETREXED (ALIMTA®), pentostatin (NIPENT®), procarbazine (MATULANE®), streptozocin (ZANOSAR®), temozolomide (TEMODAR®), teniposide (VM-26, VUMON®), TESPA (thiophosphoamide, thiotepa, TSPA, THIOPLEX®), topotecan (HYCAMTIN®), vinblastine (vinblastine sulfate, vincaleukoblastine, VLB, ALKABAN-AQ®, VELBAN®), vinorelbine (vinorelbine tartrate, NAVELBINE®), and vorinostat (ZOLINZA®).

In another embodiment, the anti-TCRβV antibody molecule, multispecific or multifunctional molecule is administered in conjunction with a biologic. Biologics useful in the treatment of cancers are known in the art and a binding molecule of the invention may be administered, for example, in conjunction with such known biologics. For example, the FDA has approved the following biologics for the treatment of breast cancer: HERCEPTIN® (trastuzumab, Genentech Inc., South San Francisco, Calif.; a humanized monoclonal antibody that has anti-tumor activity in HER2-positive breast cancer); FASLODEX® (fulvestrant, AstraZeneca Pharmaceuticals, LP, Wilmington, Del.; an estrogen-receptor antagonist used to treat breast cancer); ARIMIDEX® (anastrozole, AstraZeneca Pharmaceuticals, LP; a nonsteroidal aromatase inhibitor which blocks aromatase, an enzyme needed to make estrogen); Aromasin® (exemestane, Pfizer Inc., New York, N.Y.; an irreversible, steroidal aromatase inactivator used in the treatment of breast cancer); FEMARA® (letrozole, Novartis Pharmaceuticals, East Hanover, N.J.; a nonsteroidal aromatase inhibitor approved by the FDA to treat breast cancer); and NOLVADEX® (tamoxifen, AstraZeneca Pharmaceuticals, LP; a nonsteroidal antiestrogen approved by the FDA to treat breast cancer). Other biologics with which the binding molecules of the invention may be combined include: AVASTIN® (bevacizumab, Genentech Inc.; the first FDA-approved therapy designed to inhibit angiogenesis); and ZEVALIN® (ibritumomab tiuxetan, Biogen Idec, Cambridge, Mass.; a radiolabeled monoclonal antibody currently approved for the treatment of B-cell lymphomas).

In addition, the FDA has approved the following biologics for the treatment of colorectal cancer: AVASTIN®; ERBITUX® (cetuximab, ImClone Systems Inc., New York, N.Y., and Bristol-Myers Squibb, New York, N.Y.; is a monoclonal antibody directed against the epidermal growth factor receptor (EGFR)); GLEEVEC® (imatinib mesylate; a protein kinase inhibitor); and ERGAMISOL® (levamisole hydrochloride, Janssen Pharmaceutica Products, LP, Titusville, N.J.; an immunomodulator approved by the FDA in 1990 as an adjuvant treatment in combination with 5-fluorouracil after surgical resection in patients with Dukes' Stage C colon cancer).

For the treatment of lung cancer, exemplary biologics include TARCEVA® (erlotinib HCL, OSI Pharmaceuticals Inc., Melville, N.Y.; a small molecule designed to target the human epidermal growth factor receptor 1 (HER1) pathway).

For the treatment of multiple myeloma, exemplary biologics include VELCADE® Velcade (bortezomib, Millennium Pharmaceuticals, Cambridge Mass.; a proteasome inhibitor). Additional biologics include THALIDOMID® (thalidomide, Clegene Corporation, Warren, N.J.; an immunomodulatory agent and appears to have multiple actions, including the ability to inhibit the growth and survival of myeloma cells and anti-angiogenesis).

Additional exemplary cancer therapeutic antibodies include, but are not limited to, 3F8, abagovomab, adecatumumab, afutuzumab, alacizumab pegol, alemtuzumab (CAMPATH®, MABCAMPATH®), altumomab pentetate (HYBRI-CEAKER®), anatumomab mafenatox, anrukinzumab (IMA-638), apolizumab, arcitumomab (CEA-SCAN®), bavituximab, bectumomab (LYMPHOSCAN®), belimumab (BENLYSTA®, LYMPHOSTAT-B®), besilesomab (SCINTIMUN®), bevacizumab (AVASTIN®), bivatuzumab mertansine, blinatumomab, brentuximab vedotin, cantuzumab mertansine, capromab pendetide (PROSTAS-CINT®), catumaxomab (REMOVAB®), CC49, cetuximab (C225, ERBITUX®), citatuzumab bogatox, cixutumumab, clivatuzumab tetraxetan, conatumumab, dacetuzumab, denosumab (PROLIA®), detumomab, ecromeximab, edrecolomab (PANOREX®), elotuzumab, epitumomab cituxetan, epratuzumab, ertumaxomab (REXOMUN®), etaracizumab, farletuzumab, figitumumab, fresolimumab, galiximab, gemtuzumab ozogamicin (MYLOTARG®), girentuximab, glembatumumab vedotin, ibritumomab (ibritumomab tiuxetan, ZEVALIN®), igovomab (INDIMACIS-125®), intetumumab, inotuzumab ozogamicin, ipilimumab, iratumumab, labetuzumab (CEA-CIDE®), lexatumumab, lintuzumab, lucatumumab, lumiliximab, mapatumumab, matuzumab, milatuzumab, minretumomab, mitumomab, nacolomab tafenatox, naptumomab estafenatox, necitumumab, nimotuzumab (THERACIM®, THERALOC®), nofetumomab merpentan (VERLUMA®), ofatumumab (ARZERRA®), olaratumab, oportuzumab monatox, oregovomab (OVAREX®), panitumumab (VECTIBIX®), pemtumomab (THERAGYN®), pertuzumab (OMNITARG®), pintumomab, pritumumab, ramucirumab, ranibizumab (LUCENTIS®), rilotumumab, rituximab (MABTHERA®, RITUXAN®), robatumumab, satumomab pendetide, sibrotuzumab, siltuximab, sontuzumab, tacatuzumab tetraxetan (AFP-CIDE®), taplitumomab paptox, tenatumomab, TGN1412, ticilimumab (tremelimumab), tigatuzumab, TNX-650, tositumomab (BEXXAR®), trastuzumab (HERCEPTIN®), tremelimumab, tucotuzumab celmoleukin, veltuzumab, volociximab, votumumab (HUMASPECT®), zalutumumab (HUMAX-EGFR®), and zanolimumab (HUMAX-CD4®).

In other embodiments, the anti-TCRβV antibody molecule, multispecific or multifunctional molecule is administered in combination with a viral cancer therapeutic agent. Exemplary viral cancer therapeutic agents include, but not limited to, vaccinia virus (vvDD-CDSR), carcinoembryonic antigen-expressing measles virus, recombinant vaccinia virus (TK-deletion plus GM-CSF), Seneca Valley virus-001, Newcastle virus, coxsackie virus A21, GL-ONC1, EBNA1 C-terminal/LMP2 chimeric protein-expressing recombinant modified vaccinia Ankara vaccine, carcinoembryonic antigen-expressing measles virus, G207 oncolytic virus, modified vaccinia virus Ankara vaccine expressing p53, OncoVEX GM-CSF modified herpes-simplex 1 virus, fowlpox virus vaccine vector, recombinant vaccinia prostate-specific antigen vaccine, human papillomavirus 16/18 L1 virus-like particle/AS04 vaccine, MVA-EBNA1/LMP2 Inj. vaccine, quadrivalent HPV vaccine, quadrivalent human papillomavirus (types 6, 11, 16, 18) recombinant vaccine (GARDASIL®), recombinant fowlpox-CEA(6D)/TRICOM vaccine; recombinant vaccinia-CEA(6D)-TRICOM vaccine, recombinant modified vaccinia Ankara-5T4 vaccine, recombinant fowlpox-TRICOM vaccine, oncolytic herpes virus NV 1020, HPV L 1 VLP vaccine V504, human papillomavirus bivalent (types 16 and 18) vaccine (CERVARIX®), herpes simplex virus HF 10, Ad5CMV-p53 gene, recombinant vaccinia DF3/MUC1 vaccine, recombinant vaccinia-MUC-1 vaccine, recombinant vaccinia-TRICOM vaccine, ALVAC MART-1 vaccine, replication-defective herpes simplex virus type I (HSV-1) vector expressing human Preproenkephalin (NP2), wild-type reovirus, reovirus type 3 Dearing (REOLYSIN®), oncolytic virus HSV 1716, recombinant modified vaccinia Ankara (MVA)-based vaccine encoding Epstein-Barr virus target antigens, recombinant fowlpox-prostate specific antigen vaccine, recombinant vaccinia prostate-specific antigen vaccine, recombinant vaccinia-B7.1 vaccine, rAd-p53 gene, Ad5-delta24RGD, HPV vaccine 580299, JX-594 (thymidine kinase-deleted vaccinia virus plus GM-CSF), HPV-16/18 L1/AS04, fowlpox virus vaccine vector, vaccinia-tyrosinase vaccine, MEDI-517 HPV-16/18 VLP AS04 vaccine, adenoviral vector containing the thymidine kinase of herpes simplex virus TK99UN, HspE7, FP253/Fludarabine, ALVAC(2) melanoma multi-antigen therapeutic vaccine, ALVAC-hB7.1, canarypox-hIL-12 melanoma vaccine, Ad-REIC/Dkk-3, rAd-IFN SCH 721015, TIL-Ad-INFg, Ad-ISF35, and coxsackievirus A21 (CVA21, CAVATAK®).

In other embodiments, anti-TCRβV antibody molecule, multispecific or multifunctional molecule is administered in combination with a nanopharmaceutical. Exemplary cancer nanopharmaceuticals include, but not limited to, ABRAXANE® (paclitaxel bound albumin nanoparticles), CRLX101 (CPT conjugated to a linear cyclodextrin-based polymer), CRLX288 (conjugating docetaxel to the biodegradable polymer poly (lactic-co-glycolic acid)), cytarabine liposomal (liposomal Ara-C, DEPOCYT™), daunorubicin liposomal (DAUNOXOME®), doxorubicin liposomal (DOXIL®, CAELYX®), encapsulated-daunorubicin citrate liposome (DAUNOXOME®), and PEG anti-VEGF aptamer (MACUGEN®).

In some embodiments, the anti-TCRβV antibody molecule, multispecific or multifunctional molecule is administered in combination with paclitaxel or a paclitaxel formulation, e.g., TAXOL®, protein-bound paclitaxel (e.g., ABRAXANE®). Exemplary paclitaxel formulations include, but are not limited to, nanoparticle albumin-bound paclitaxel (ABRAXANE®, marketed by Abraxis Bioscience), docosahexaenoic acid bound-paclitaxel (DHA-paclitaxel, Taxoprexin, marketed by Protarga), polyglutamate bound-paclitaxel (PG-paclitaxel, paclitaxel poliglumex, CT-2103, XYOTAX, marketed by Cell Therapeutic), the tumor-activated prodrug (TAP), ANG105 (Angiopep-2 bound to three molecules of paclitaxel, marketed by ImmunoGen), paclitaxel-EC-1 (paclitaxel bound to the erbB2-recognizing peptide EC-1; see Li et al., *Biopolymers* (2007) 87:225-230), and glucose-conjugated paclitaxel (e.g., 2'-paclitaxel methyl 2-glucopyranosyl succinate, see Liu et al., *Bioorganic & Medicinal Chemistry Letters* (2007) 17:617-620).

Exemplary RNAi and antisense RNA agents for treating cancer include, but not limited to, CALAA-01, siG12D LODER (Local Drug EluteR), and ALN-VSP02.

Other cancer therapeutic agents include, but not limited to, cytokines (e.g., aldesleukin (IL-2, Interleukin-2, PROLEUKIN®), alpha Interferon (IFN-alpha, Interferon alfa, INTRON® A (Interferon alfa-2b), ROFERON-A® (Interferon alfa-2a)), Epoetin alfa (PROCRIT®), filgrastim (G-CSF, Granulocyte -Colony Stimulating Factor, NEUPOGEN®), GM-CSF (Granulocyte Macrophage Colony Stimulating Factor, sargramostim, LEUKINE™), IL-11 (Interleukin-11, oprelvekin, NEUMEGA®), Interferon alfa-2b (PEG conjugate) (PEG interferon, PEG-INTRON™), and pegfilgrastim (NEULASTA™)), hormone therapy agents (e.g., aminoglutethimide (CYTADREN®), anastrozole (ARIMIDEX®), bicalutamide (CASODEX®), exemestane (AROMASIN®), fluoxymesterone (HALOTESTIN®), flutamide (EULEXIN®), fulvestrant (FASLODEX®), goserelin (ZOLADEX®), letrozole (FEMARA®), leuprolide (ELIGARD™, LUPRON®, LUPRON DEPOT®, VIADUR™), megestrol (megestrol acetate, MEGACE®), nilutamide (ANANDRON®, NILANDRON®), octreotide (octreotide acetate, SANDOSTATIN®, SANDOSTATIN LAR®), raloxifene (EVISTA®), romiplostim (NPLATE®), tamoxifen (NOVALDEX®), and toremifene (FARESTON®)), phospholipase A2 inhibitors (e.g., anagrelide (AGRYLIN®)), biologic response modifiers (e.g., BCG (THERACYS®, TICE®), and Darbepoetin alfa (ARANESP®)), target therapy agents (e.g., bortezomib (VELCADE®), dasatinib (SPRYCEL™), denileukin diftitox (ONTAK®), erlotinib (TARCEVA®), everolimus (AFINITOR®), gefitinib (IRESSA®), imatinib mesylate (STI-571, GLEEVEC™), lapatinib (TYKERB®), sorafenib (NEXAVAR®), and SU11248 (sunitinib, SUTENT®)), immunomodulatory and antiangiogenic agents (e.g., CC-5013 (lenalidomide, REVLIMID®), and thalidomide (THALOMID®)), glucocorticosteroids (e.g., cortisone (hydrocortisone, hydrocortisone sodium phosphate, hydrocortisone sodium succinate, ALA-CORT®, HYDROCORT ACETATE®, hydrocortone phosphate LANACORT®, SOLU-CORTEF®), decadron (dexamethasone, dexamethasone acetate, dexamethasone sodium phosphate, DEXASONE®, DIODEX®, HEXADROL®, MAXIDEX®), methylprednisolone (6-methylprednisolone, methylprednisolone acetate, methylprednisolone sodium succinate, DURALONE®, MEDRALONE®, MEDROL®, M-PREDNISOL®, SOLU-MEDROL®), prednisolone (DELTA-CORTEF®, ORAPRED®, PEDIAPRED®, PRELONE®), and prednisone (DELTASONE®, LIQUID PRED®, METICORTEN®, ORASONE®)), and bisphosphonates (e.g., pamidronate (AREDIA®), and zoledronic acid (ZOMETA®)) In some embodiments, the anti-TCRβV antibody molecule, multispecific or multifunctional molecule is used in combination with a tyrosine kinase inhibitor (e.g., a receptor tyrosine kinase (RTK) inhibitor). Exemplary tyrosine kinase inhibitor include, but are not limited to, an epidermal growth factor (EGF) pathway inhibitor (e.g., an epidermal growth factor receptor (EGFR) inhibitor), a vascular endothelial growth factor (VEGF) pathway inhibitor (e.g., an antibody against VEGF, a VEGF trap, a vascular endothelial growth factor receptor (VEGFR) inhibitor (e.g., a VEGFR-1 inhibitor, a VEGFR-2 inhibitor, a VEGFR-3 inhibitor)), a platelet derived growth factor (PDGF) pathway inhibitor (e.g., a platelet derived growth factor receptor (PDGFR) inhibitor (e.g., a PDGFR-ß inhibitor)), a RAF-1 inhibitor, a KIT inhibitor and a RET inhibitor. In some embodiments, the anti-cancer agent used in combination with the AHCM agent is selected from the group consisting of: axitinib (AG013736), bosutinib (SKI-606), cediranib (RECENTIN™, AZD2171), dasatinib (SPRYCEL®, BMS-354825), erlotinib (TARCEVA®), gefitinib (IRESSA®), imatinib (Gleevec®, CGP57148B, STI-571), lapatinib (TYKERB®, TYVERB®), lestaurtinib (CEP-701), neratinib (HKI-272), nilotinib (TASIGNA®), semaxanib (semaxinib, SU5416), sunitinib (SUTENT®, SU11248), toceranib (PALLADIA®), vandetanib (ZACTIMA®, ZD6474), vatalanib (PTK787, PTK/ZK), trastuzumab (HERCEPTIN®), bevacizumab (AVASTIN®), rituximab (RITUXAN®), cetuximab (ERBITUX®), panitumumab (VECTIBIX®), ranibizumab (Lucentis®), nilotinib (TASIGNA®), sorafenib (NEXAVAR®), alemtuzumab (CAMPATH®), gemtuzumab ozogamicin (MYLOTARG®), ENMD-2076, PCI-32765, AC220, dovitinib lactate (TKI258, CHIR-258), BIBW 2992 (TOVOK™), SGX523, PF-04217903, PF-02341066, PF-299804, BMS-777607, ABT-869, MP470, BIBF 1120 (VARGATEF®), AP24534, JNJ-26483327, MGCD265, DCC-2036, BMS-690154, CEP-11981, tivozanib (AV-951), OSI-930, MM-121, XL-184, XL-647, XL228, AEE788, AG-490, AST-6, BMS-599626, CUDC-101, PD153035, pelitinib (EKB-569), vandetanib (zactima), WZ3146, WZ4002, WZ8040, ABT-869 (linifanib), AEE788, AP24534 (ponatinib), AV-951(tivozanib), axitinib, BAY 73-4506 (regorafenib), brivanib alaninate (BMS-582664), brivanib (BMS-540215), cediranib (AZD2171), CHIR-258 (dovitinib), CP 673451, CYC116, E7080, Ki8751, masitinib (AB1010), MGCD-265, motesanib diphosphate (AMG-706), MP-470, OSI-930, Pazopanib Hydrochloride, PD173074, Sorafenib Tosylate (Bay 43-9006), SU 5402, TSU-68(SU6668), vatalanib, XL880 (GSK1363089, EXEL-2880). Selected tyrosine kinase inhibitors are chosen from sunitinib, erlotinib, gefitinib, or sorafenib. In one embodiment, the tyrosine kinase inhibitor is sunitinib.

In one embodiment, the anti-TCRβV antibody molecule, multispecific or multifunctional molecule is administered in combination with one of more of: an anti-angiogenic agent, or a vascular targeting agent or a vascular disrupting agent. Exemplary anti-angiogenic agents include, but are not limited to, VEGF inhibitors (e.g., anti-VEGF antibodies (e.g., bevacizumab); VEGF receptor inhibitors (e.g., itraconazole); inhibitors of cell proliferatin and/or migration of endothelial cells (e.g., carboxyamidotriazole, TNP-470); inhibitors of angiogenesis stimulators (e.g., suramin), among others. A vascular-targeting agent (VTA) or vascular disrupting agent (VDA) is designed to damage the vasculature (blood vessels) of cancer tumors causing central necrosis (reviewed in, e.g., Thorpe, P. E. (2004) Clin. Cancer Res. Vol. 10:415-427). VTAs can be small-molecule. Exemplary small-molecule VTAs include, but are not limited to, microtubule destabilizing drugs (e.g., combretastatin A-4 disodium phosphate (CA4P), ZD6126, AVE8062, Oxi 4503); and vadimezan (ASA404).

Immune Checkpoint Inhibitors

In other embodiments, methods described herein comprise use of an immune checkpoint inhibitor in combination with the anti-TCRβV antibody molecule, multispecific or multifunctional molecule. The methods can be used in a therapeutic protocol in vivo.

In embodiments, an immune checkpoint inhibitor inhibits a checkpoint molecule. Exemplary checkpoint molecules include but are not limited to CTLA4, PD1, PD-L1, PD-L2, TIM3 LAG3, CD160, 2B4, CD80, CD86, B7-H3 (CD276), B7-H4 (VTCN1), HVEM (TNFRSF14 or CD270), BTLA, KIR, MHC class I, MHC class II, GAL9, VISTA, BTLA, TIGIT, LAIR1, and A2aR. See, e.g., Pardoll. Nat. Rev. Cancer 12.4 (2012):252-64, incorporated herein by reference.

In embodiments, the immune checkpoint inhibitor is a PD-1 inhibitor, e.g., an anti-PD-1 antibody such as Nivolumab, Pembrolizumab or Pidilizumab. Nivolumab (also called MDX-1106, MDX-1106-04, ONO-4538, or BMS-936558) is a fully human IgG4 monoclonal antibody that specifically inhibits PD1. See, e.g., U.S. Pat. No. 8,008,449 and WO2006/121168. Pembrolizumab (also called Lambrolizumab, MK-3475, MK03475, SCH-900475 or KEYTRUDA®; Merck) is a humanized IgG4 monoclonal antibody that binds to PD-1. See, e.g., Hamid, O. et al. (2013) New England Journal of Medicine 369 (2): 134-44, U.S. Pat. No. 8,354,509 and WO2009/114335. Pidilizumab (also called CT-011 or Cure Tech) is a humanized IgG1k monoclonal antibody that binds to PD1. See, e.g., WO2009/101611. In one embodiment, the inhibitor of PD-1 is an antibody molecule having a sequence substantially identical or similar thereto, e.g., a sequence at least 85%, 90%, 95% identical or higher to the sequence of Nivolumab, Pembrolizumab or Pidilizumab. Additional anti-PD1 antibodies, e.g., AMP 514 (Amplimmune), are described, e.g., in U.S. Pat. No. 8,609,089, US 2010028330, and/or US 20120114649.

In some embodiments, the PD-1 inhibitor is an immunoadhesin, e.g., an immunoadhesin comprising an extracellular/PD-1 binding portion of a PD-1 ligand (e.g., PD-L1 or PD-L2) that is fused to a constant region (e.g., an Fc region of an immunoglobulin). In embodiments, the PD-1 inhibitor is AMP-224 (B7-DCIg, e.g., described in WO2011/066342 and WO2010/027827), a PD-L2 Fc fusion soluble receptor that blocks the interaction between B7-H1 and PD-1.

In embodiments, the immune checkpoint inhibitor is a PD-L1 inhibitor, e.g., an antibody molecule. In some embodiments, the PD-L1 inhibitor is YW243.55.570, MPDL3280A, MEDI-4736, MSB-0010718C, or MDX-1105. In some embodiments, the anti-PD-L1 antibody is MSB0010718C (also called A09-246-2; Merck Serono), which is a monoclonal antibody that binds to PD-L1. Exemplary humanized anti-PD-L1 antibodies are described, e.g., in WO2013/079174. In one embodiment, the PD-L1 inhibitor is an anti-PD-L1 antibody, e.g., YW243.55.S70. The YW243.55.S70 antibody is described, e.g., in WO 2010/077634. In one embodiment, the PD-L1 inhibitor is MDX-1105 (also called BMS-936559), which is described, e.g., in WO2007/005874. In one embodiment, the PD-L1 inhibitor is MDPL3280A (Genentech/Roche), which is a human Fc-optimized IgG1 monoclonal antibody against PD-L1. See, e.g., U.S. Pat. No. 7,943,743 and U.S. Publication No.: 20120039906. In one embodiment, the inhibitor of PD-L1 is an antibody molecule having a sequence substantially identical or similar thereto, e.g., a sequence at least 85%, 90%, 95% identical or higher to the sequence of YW243.55.S70, MPDL3280A, MEDI-4736, MSB-0010718C, or MDX-1105.

In embodiments, the immune checkpoint inhibitor is a PD-L2 inhibitor, e.g., AMP-224 (which is a PD-L2 Fc fusion soluble receptor that blocks the interaction between PD 1 and B7-H1. See, e.g., WO2010/027827 and WO2011/066342.

In one embodiment, the immune checkpoint inhibitor is a LAG-3 inhibitor, e.g., an anti LAG-3 antibody molecule. In embodiments, the anti-LAG-3 antibody is BMS-986016 (also called BMS986016; Bristol-Myers Squibb). BMS-986016 and other humanized anti-LAG-3 antibodies are described, e.g., in US 2011/0150892, WO2010/019570, and WO2014/008218.

In embodiments, the immune checkpoint inhibitor is a TIM-3 inhibitor, e.g., anti-TIM3 antibody molecule, e.g., described in U.S. Pat. No. 8,552,156, WO 2011/155607, EP 2581113 and U.S. Publication No.: 2014/044728.

In embodiments, the immune checkpoint inhibitor is a CTLA-4 inhibitor, e.g., anti-CTLA-4 antibody molecule. Exemplary anti-CTLA4 antibodies include Tremelimumab (IgG2 monoclonal antibody from Pfizer, formerly known as ticilimumab, CP-675,206); and Ipilimumab (also called MDX-010, CAS No. 477202-00-9). Other exemplary anti-CTLA-4 antibodies are described, e.g., in U.S. Pat. No. 5,811,097.

CRS Grading

In some embodiments, CRS can be graded in severity from 1-5 as follows. Grades 1-3 are less than severe CRS. Grades 4-5 are severe CRS. For Grade 1 CRS, only symptomatic treatment is needed (e.g., nausea, fever, fatigue, myalgias, malaise, headache) and symptoms are not life threatening. For Grade 2 CRS, the symptoms require moderate intervention and generally respond to moderate intervention. Subjects having Grade 2 CRS develop hypotension that is responsive to either fluids or one low-dose vasopressor; or they develop grade 2 organ toxicity or mild respiratory symptoms that are responsive to low flow oxygen (<40% oxygen). In Grade 3 CRS subjects, hypotension generally cannot be reversed by fluid therapy or one low-dose vasopressor. These subjects generally require more than low flow oxygen and have grade 3 organ toxicity (e.g., renal or cardiac dysfunction or coagulopathy) and/or grade 4 transaminitis. Grade 3 CRS subjects require more aggressive intervention, e.g., oxygen of 40% or higher, high dose vasopressor(s), and/or multiple vasopressors. Grade 4 CRS subjects suffer from immediately life-threatening symptoms, including grade 4 organ toxicity or a need for mechanical ventilation. Grade 4 CRS subjects generally do not have transaminitis. In Grade 5 CRS subjects, the toxicity causes death. Sets of criteria for grading CRS are provided herein as Table 5, Table 6, and Table 7. Unless otherwise specified, CRS as used herein refers to CRS according to the criteria of Table 6.

In embodiments, CRS is graded according to Table 5:

TABLE 5

CRS grading

| | |
|---|---|
| Gr1 | Supportive care only |
| Gr2 | IV therapies +/− hospitalization. |
| Gr3 | Hypotension requiring IV fluids or low-dose vasoactives or hypoxemia requiring oxygen, CPAP, or BIPAP. |
| Gr4 | Hypotension requiring high-dose vasoactives or hypoxemia requiring mechanical ventilation. |
| Gr 5 | Death |

TABLE 6

CTCAE v 4.0 CRS grading scale

| CRS grade | Characteristics |
|---|---|
| Grade 1 | Mild; No infusion interruption; No intervention |
| Grade 2 | Infusion interruption indicated but responds promptly to symptomatic treatment (e.g., antihistamines, NSAIDS, narcotics, IV fluids); prophylactic medications indicated for <= 24 hrs |
| Grade 3 | Prolonged (e.g., not rapidly responsive to symptomatic medications and/or brief interruption of infusion); recurrence of symptoms following initial improvement; hospitalization indicated for clinical sequelae (e.g., renal impairment, pulmonary infiltrates) |
| Grade 4 | Life threatening consequences; pressor or ventilator support |

TABLE 7

NCI CRS grading scale

| CRS grade | Characteristics |
|---|---|
| Grade 1 | Symptoms are not life threatening and require symptomatic treatment only; e.g., fever, nausea, fatigue, headache, myalgias, malaise |
| Grade 2 | Symptoms require and respond to moderate intervention; Oxygen requirement <40% or hypotension responsive to fluids or low dose pressors or Grade 2 organ toxicity |
| Grade 3 | Symptoms require and respond to aggressive intervention; Oxygen requirement >=40% or Hypotension requiring high dose or multiple pressors or grade 3 organ toxicity or grade 4 transaminitis |
| Grade 4 | Life threatening symptoms Requirement for ventilator support or Grade 4; organ toxicity (excluding transaminitis) |

EXAMPLES

Example 1. Humanization of α-TRBV6-5 Antibody Clone Antibody A

The germline for the mouse α-TCRβ antibody clone Antibody A VH and VL were assigned using IMGT nomenclature, with CDR regions defined by a combined Kabat and Chothia classification. SEQ ID NO: 1 and SEQ ID NO: 2 are the Antibody A VH and VL sequences respectively where the VH germline is mouse IGHV1S12*01 and the VL germline is mouse IGKV6-15*01. SEQ ID NOs: 3-5 are the Antibody A VH CDR regions 1-3 respectively and SEQ ID NOs: 6-8 correspond to the VL CDR regions 1-3 (as described in Table 1).

Humanization of the Antibody A VH and VL sequences was done separately using similar methodology. Amino acids positions were identified in the framework regions which were important for the success of CDR grafting. Human germline sequences were identified which preserved the necessary residues and contained a high amount of overall identity. When the human germline framework sequence did not contain a matching important amino acid, it was back mutated to match the mouse sequence. CDR regions were grafted onto the human germline unchanged. The Antibody A VH was humanized into human IGHV1-69*01 and the Antibody A VL was humanized into IGKV1-17*01 and IGKV1-27*01. All 3 humanized sequences were confirmed to contain no introduced potential negative post translational modification sites such as NG, DG, NS, NN, DS, NT, NXS, or NXT as a result of the humanization process. SEQ ID NO: 9 is the humanized Antibody A-H.1 VH and SEQ ID NOs: 10 and 11 are the humanized VL IGKV1-17*01 and IGKV1-27*01 germlines respectively (as described in Table 1). FIGS. 1A and 1B show the murine and humanized sequences with annotations depicting the CDR and framework regions (FR).

Example 2: Humanization of α-TRBV12-3 and TRBV12-4 Antibody Clone Antibody B

The germline for the mouse α-TCRβ antibody clone Antibody B VH and VL were assigned using IMGT nomenclature, with CDR regions defined by a combined Kabat and Chothia classification. SEQ ID NO: 15 and SEQ ID NO: 16 are the Antibody B VH and VL sequences respectively where the VH germline is mouse IGHV5-17*02 and the VL germline is mouse IGKV4-50*01. SEQ ID NOs: 17-19 are the B-H VH CDR regions 1-3 respectively and SEQ ID NOs: 20-22 are the B-H VL CDR regions 1-3 (as described in Table 2).

The method applied to humanize Antibody A described in Example 1 was used to humanize Antibody B. The Antibody B VH was humanized into human IGHV3-30*01, IGHV3-48*01, and IGHV3-66*01 and the Antibody B VL was humanized into human IGKV1-9*01, IGKV1-39*01, IGKV3-15*01, IGLV1-47*01 and IGLV3-10*01. SEQ ID NOs: 23-25 are the B-H.1A, B-H.1B, and B-H.1C humanized heavy chains and SEQ ID NOs: 26-30 are the B-H.1D, B-H.1E, B-H.1F, B-H.1G and B-H.1H humanized light chains (as described in Table 2). FIGS. 2A and 2B show the murine and humanized sequences with annotations depicting the CDR and framework regions (FR).

Example 3: Characteristics of Anti-TCRβV Antibodies

Introduction

Current bispecific constructs designed to redirect T cells to promote tumor cell lysis for cancer immunotherapy typically utilize single chain variable fragments (scFVs) that are derived from monoclonal antibodies (mAb) directed against the CD3e subunit of the T cell receptor (TCR). However, there are limitations to this approach which may prevent the full realization of the therapeutic potential for such bispecific constructs. Previous studies have shown that, e.g., low "activating" doses of anti-CD3e mAb can cause long-term T cell dysfunction and exert immunosuppressive effects. In addition, anti-CD3e mAbs bind to all T cells and thus activate equally all T cells, which has been associated with the first dose side effects of anti-CD3e mAbs that result from massive T cell activation. These large number of activated T cells secrete substantial amounts of cytokines, the most important of which is Interferon gamma (IFNg). This excess amount of IFNg in turn, e.g., activates macrophages which then can overproduce proinflammatory cytokines such as IL-1, IL-6 and TNF-alpha, causing a "cytokine storm" known as the cytokine release syndrome (CRS). Thus, it might be advantageous to develop antibodies that are capable of binding and activating only a subset of necessary effector T cells to reduce the CRS.

Results

Figure 4A:
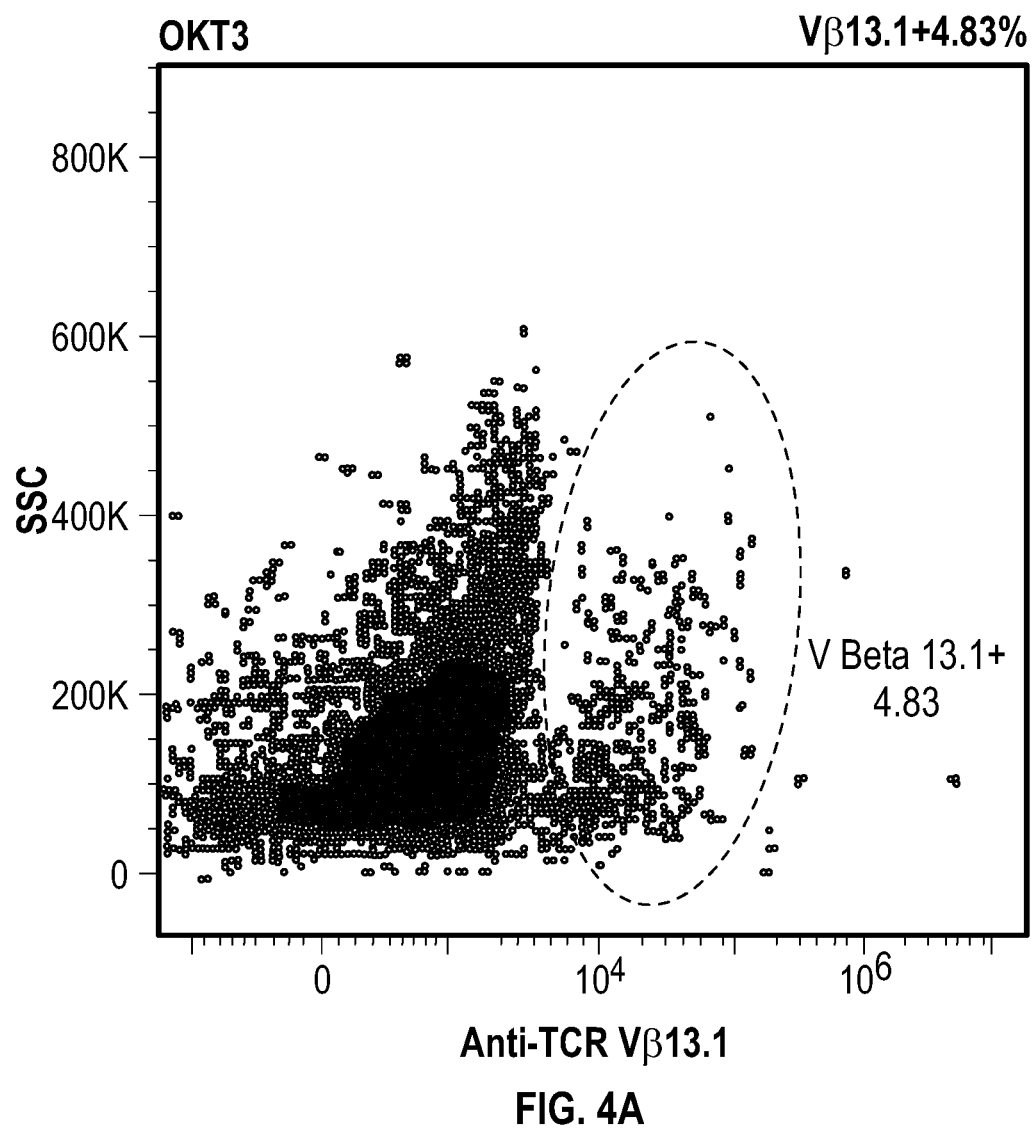
FIGS. 4A-4C show human CD3+ T cells activated by anti-TCR Vβ13.1 antibody (A-H.1) for 6-days. Human CD3+ T cells were isolated using magnetic-bead separation (negative selection) and activated with immobilized (plate-coated) anti-TCR Vβ13.1 (A-H.1) or anti-CD3ε (OKT3) antibodies at 100 nM for 6 days.
Figure 4A:
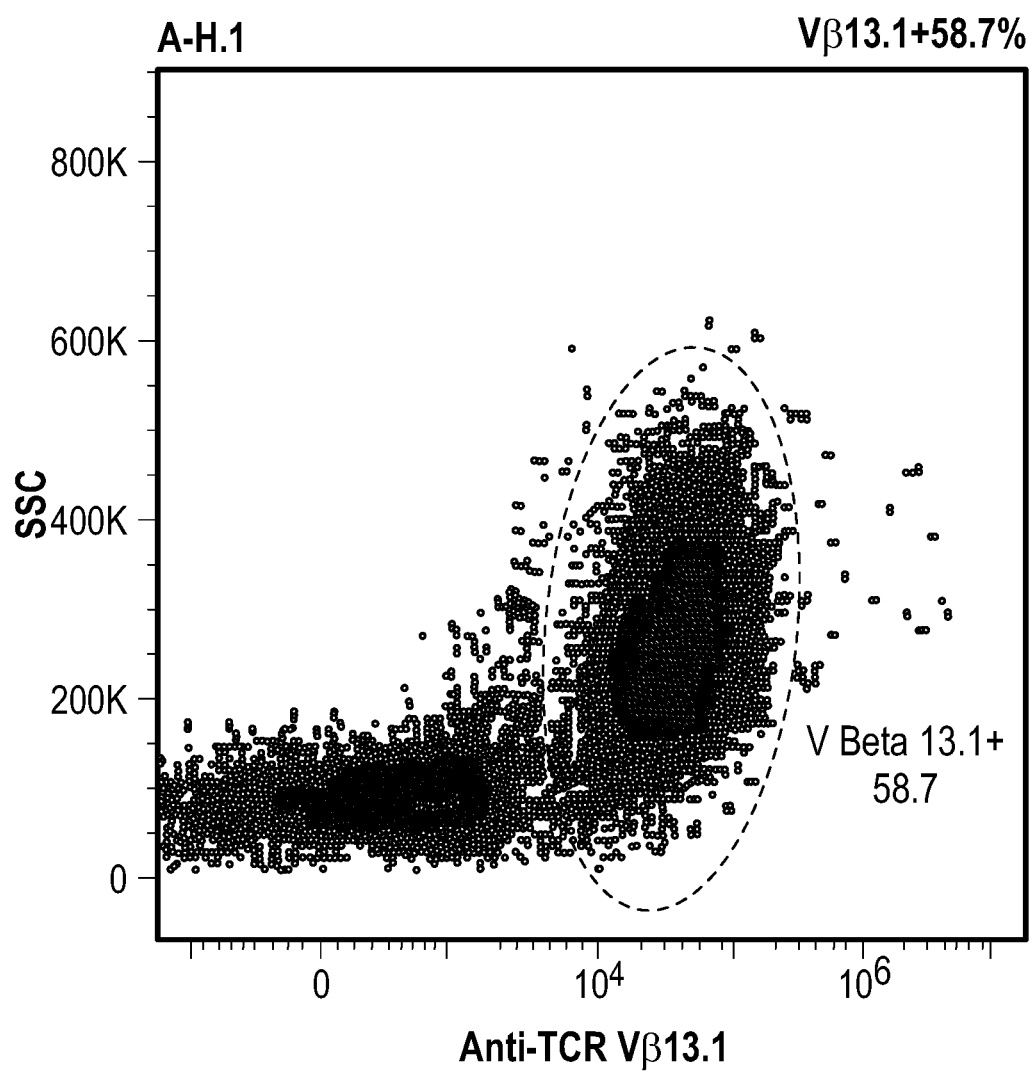
Figure 4B:
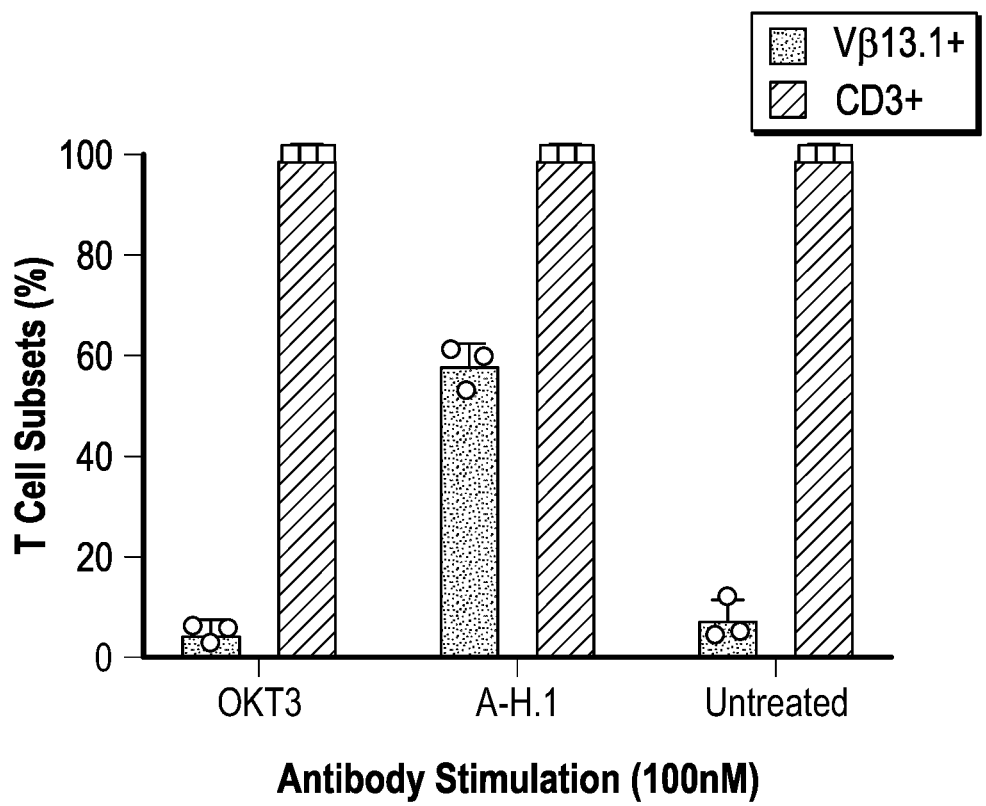
Figure 4C:
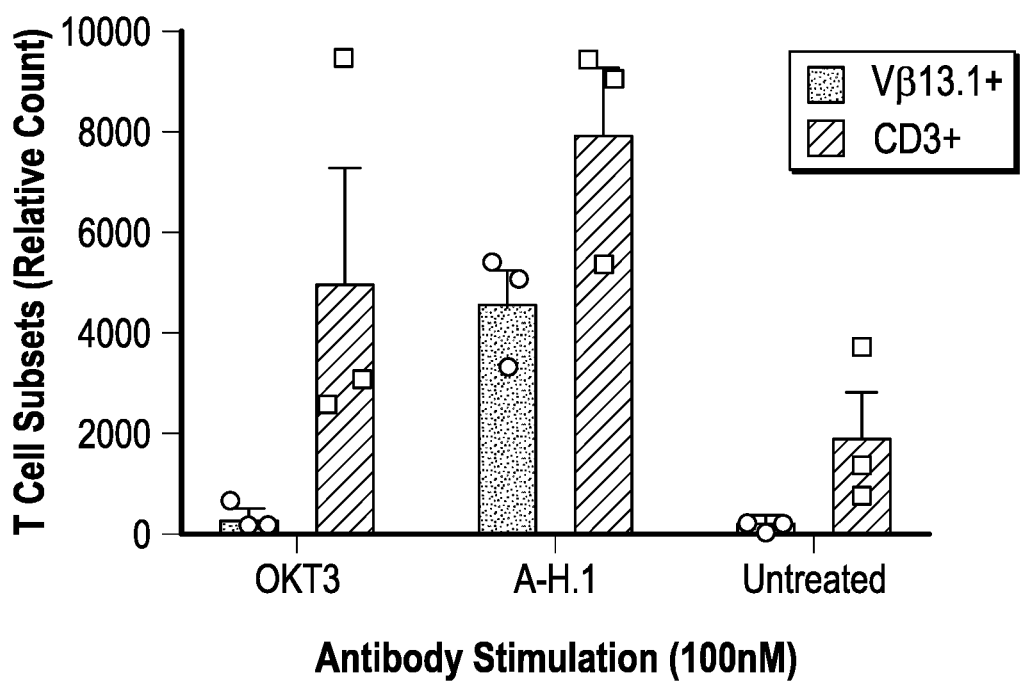
Figure 5A:
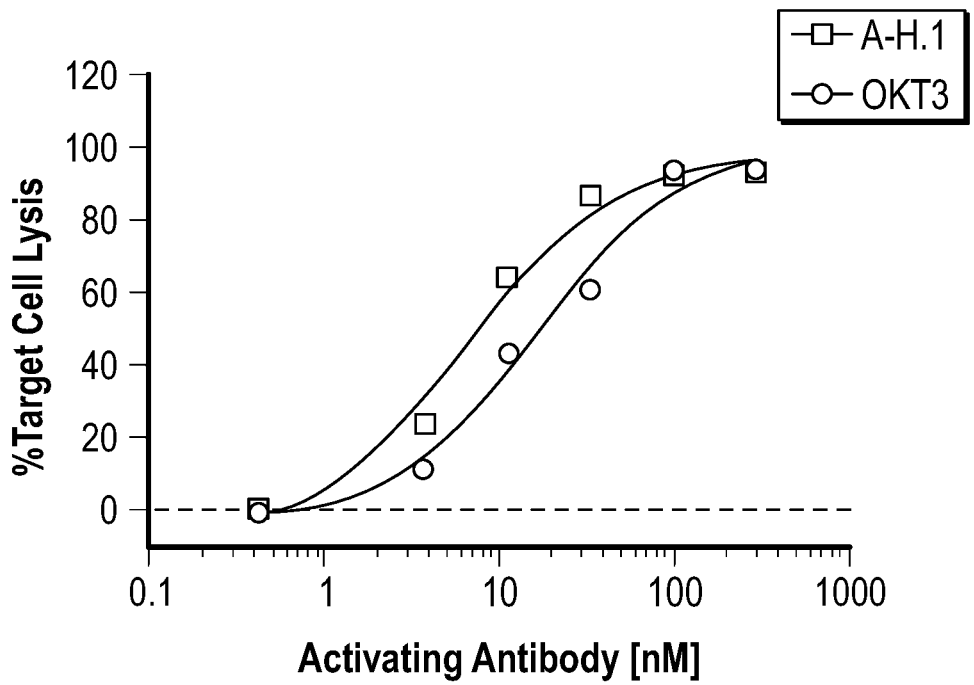
FIGS. 5A-5B show cytolytic activity of human CD3+ T cells activated by anti-TCR Vβ13.1 antibody (A-H.1) against transformed cell line RPMI 8226.
Figure 5B:
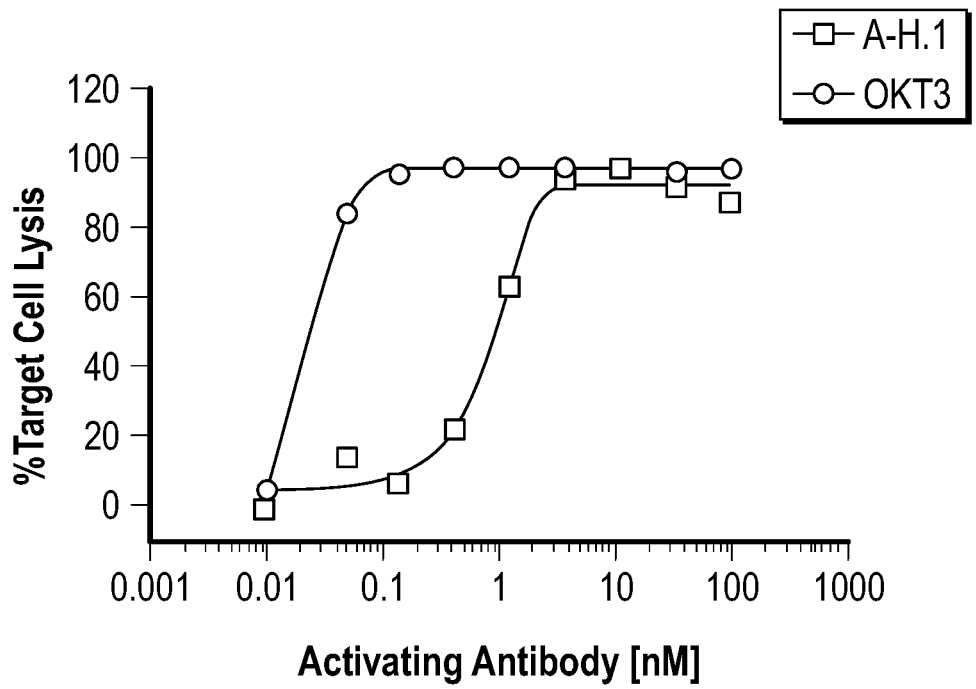

To that end, antibodies directed to the variable chain of the beta subunit of TCR (TCR Vb) were identified. These anti-TCR Vb antibodies bind and activate a subset of T cells, but with, e.g., no or markedly reduced CRS. Using plate-bound anti-TCR Vb13.1 mAbs (A-H.1 and A-H.2) it was shown that a population of T cells, defined by positive staining with A-H.1, can be expanded (from ~5% of T cells on day 0 to almost 60% of total T cells on day 6 of cell culture) (FIGS. 4A-4C). For this experiment, human CD3+ T cells were isolated using magnetic-bead separation (negative selection) and activated with immobilized (plate-coated) A-H.1 or OKT3 (anti-CD3e) antibodies at 100 nM for 6 days. The expanded Vb13.1+ T cells display cytolytic activity against transformed cell line RPMI-8226 when co-cultured with purified CD3+ T cells (FIGS. 5A-5B).

Next, the ability of PBMCs activated by anti-TCR VB antibodies to produce cytokines was assessed. The cytokine production of PBMCs activated with anti-TCR VB antibodies was compared to the cytokine production of PBMCs activated with: (i) anti-CD3e antibodies (OKT3 or SP34-2); (ii) anti-TCR V alpha (TCR VA) antibodies including anti-TCR VA 12.1 antibody 6D6.6, anti-TCR VA24JA18 antibody 6B11; (iii) anti-TCR alpha beta antibody T10B9; and/or (iv) isotype control (BGM0109). The anti-TCR VB antibodies tested include: humanized anti-TCRVB 13.1 antibodies (A-H.1, or A-H.2), murine anti-TCR VB5 antibody Antibody E, murine anti-TCR VB8.1 antibody Antibody B, and murine anti-TCR VB 12 antibody Antibody D.

BGM0109 comprises the amino acid sequence of METDTLLLWVLLLWVPGSTGGLNDIFEAQK-IEWHEGGGGSEPRTDTDTCPNPPDPCPTC PTPDLLGGPSVFIFPPKPKDVLMISLTPKITCVVVDV-SEEEPDVQFNWYVNNVEDKTAQT ETRQRQYN-STYRVVSVLPIKHQDWMSGKVFKCKVNN-NALPSPIEKTISKPRGQVRVPQI YTFPPPIEQTVKKDVSVTCLVTGFLPQ-DIHVEWESNGQPQPEQNYKNTQPVLDSDGSYFL YSKLNVPKSRWDQGDSFTCSVIHEALHNHHMTKTIS-RSLGNGGGGS (SEQ ID NO: 3282).

Figure 6A:
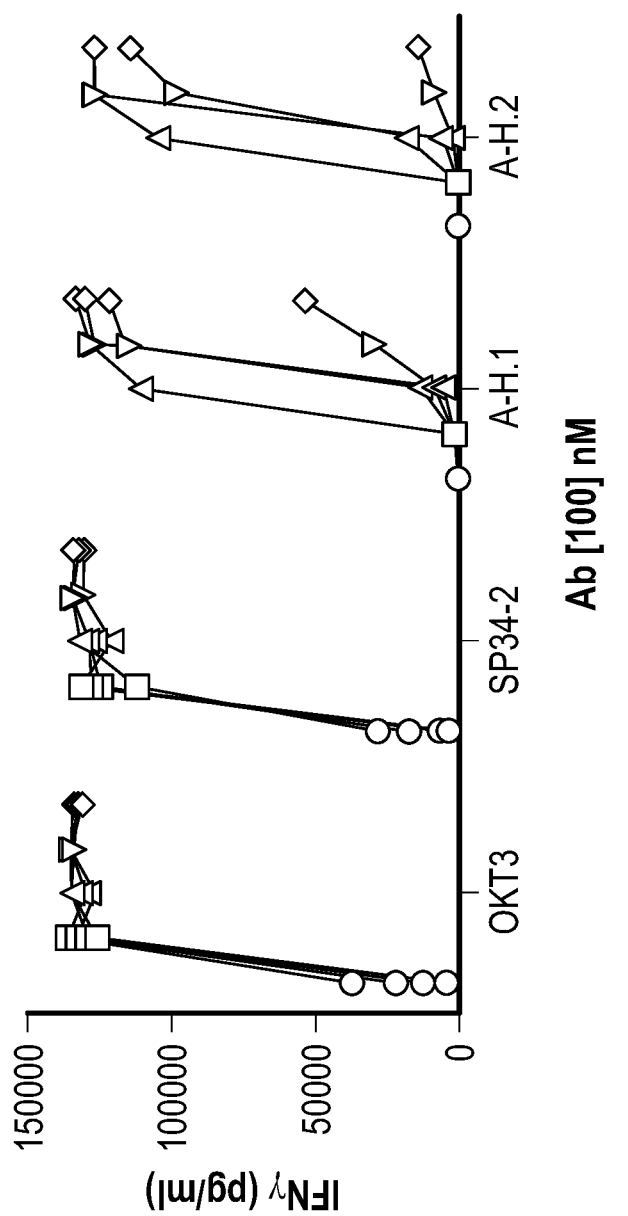
FIGS. 6A-6B show IFNg production by human PBMCs activated with the indicated antibodies. Human PBMCs were isolated from whole blood from the indicated number of donors, followed by solid-phase (plate-coated) stimulation with the indicated antibodies at 100 Nm. Supernatant was collected on Days 1, 2, 3, 5, or 6.
Figure 6B:
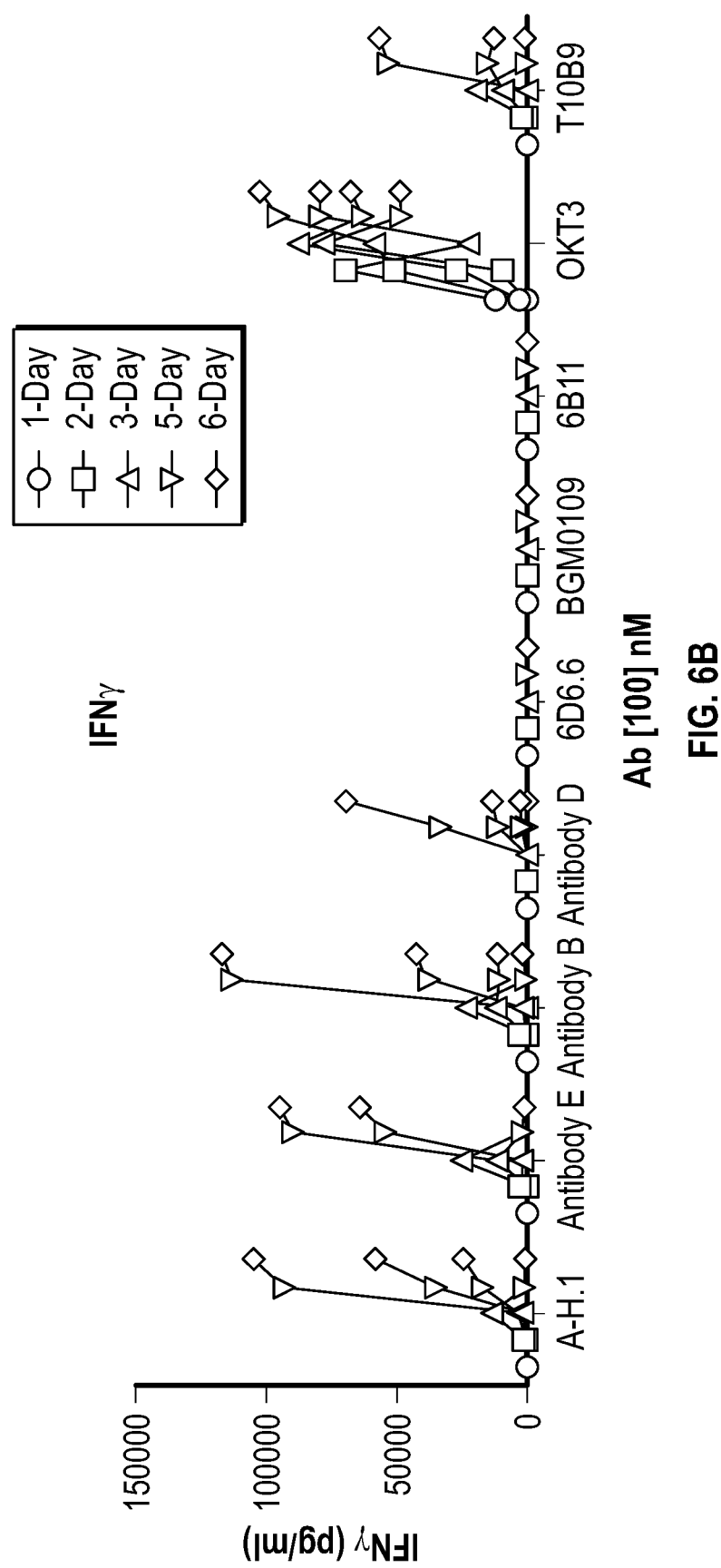

As shown in FIG. 6A, when plate-bound A-H.1 or A-H.2, or anti-CD3e antibodies (OKT3 or SP34-2) were used to activate human PBMCs, the T cell cytokine IFNg was induced (FIG. 6A). All anti-TCR VB antibodies tested had a similar effect on the production of IFNg (FIG. 6B). The anti-TCR VA antibodies did not induce similar IFNg production.

Figure 7A:
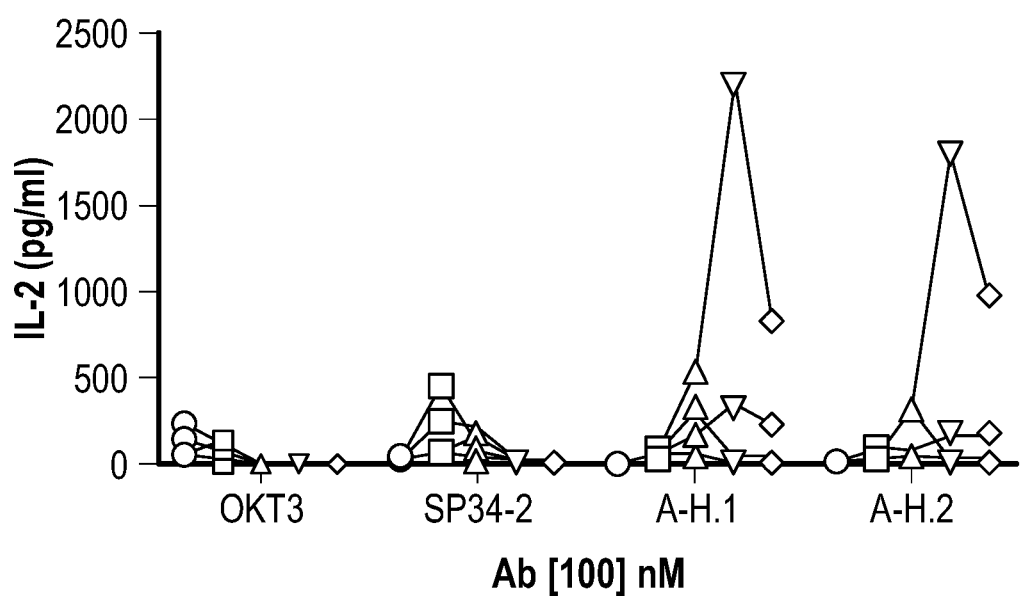
FIGS. 7A-7B show IL-2 production by human PBMCs activated with the indicated antibodies. A similar experimental setup as described for FIGS. 6A-6B was used.
Figure 7B:
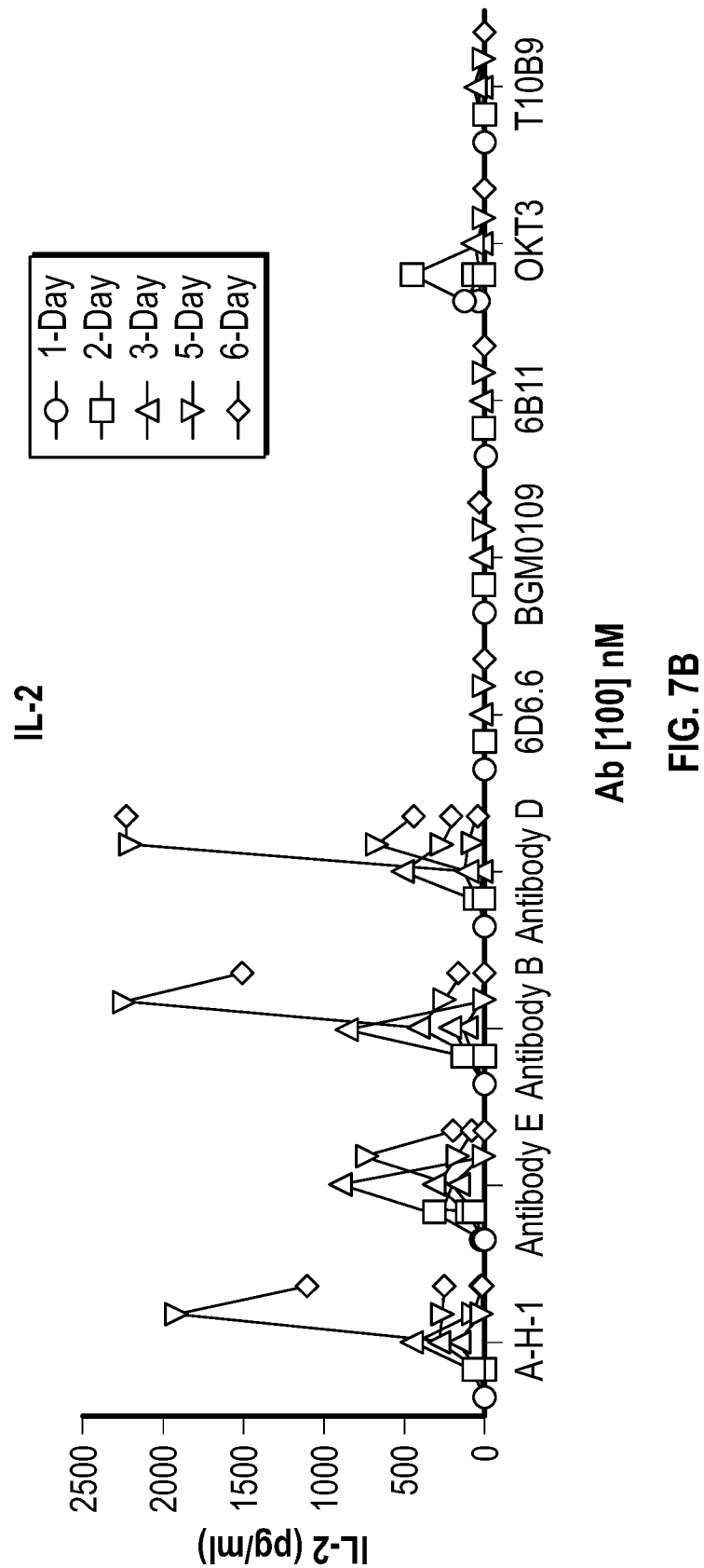

With respect to IL-2 production, PBMCs activated with A-H.1 and A-H.2 resulted in increased IL-2 production (FIG. 7A) with delayed kinetics (FIG. 7B) as compared to PBMCs activated with anti-CD3e antibodies (OKT3 or SP34-2). FIG. 7B shows that anti-TCR VB antibody activated PBMCs demonstrate peak production of IL-2 at Day 5 or Day 6 post-activation (incubation with plate-coated antibodies). In contrast, IL-2 production in PBMCs activated with OKT3 peaked at day 2 post-activation. As with IFNG, the IL-2 effect (e.g., enhanced production of IL-2 and delayed kinetics) was similar across all anti-TCR VB antibodies tested (FIG. 7B).

Figure 8A:
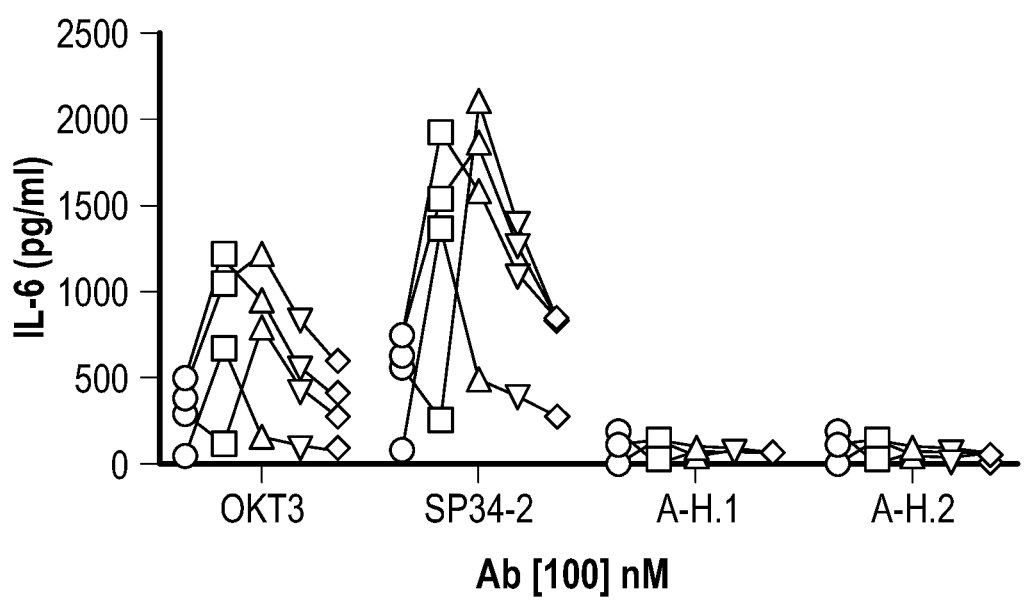
FIGS. 8A-8B show IL-6 production by human PBMCs activated with the indicated antibodies. A similar experimental setup as described for FIGS. 6A-6B was used.
Figure 8B:
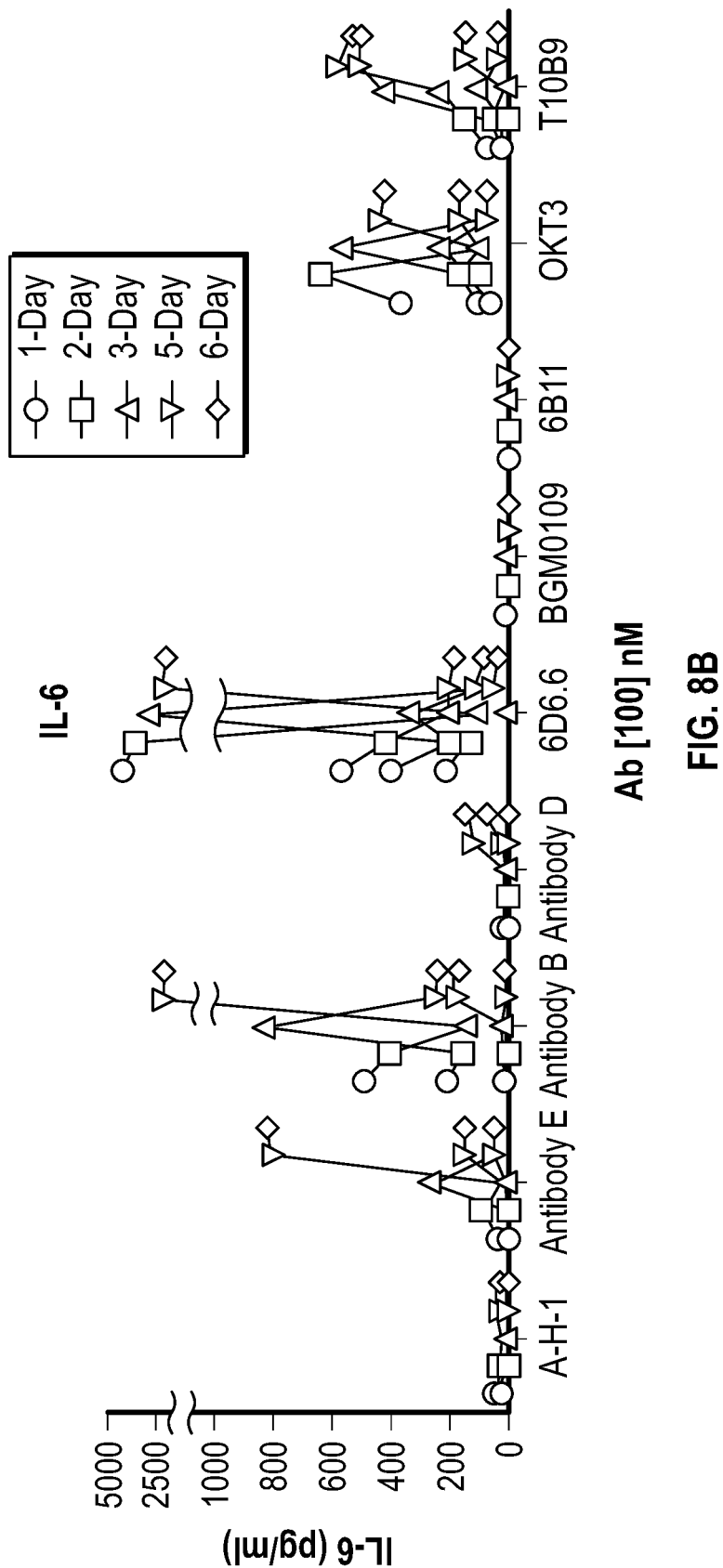
Figure 9A:
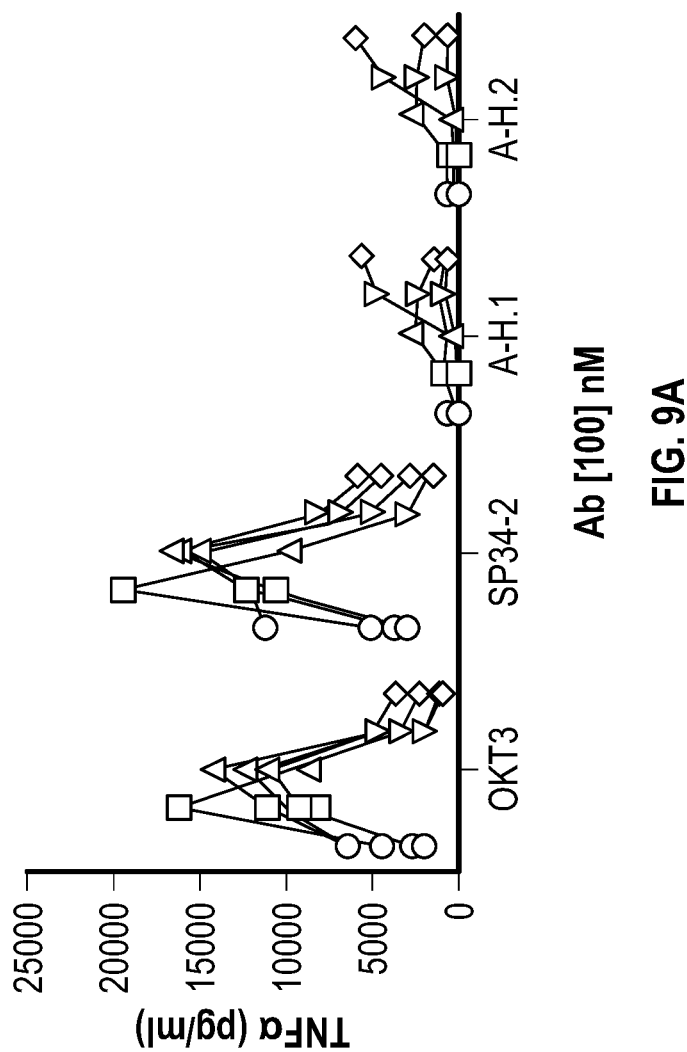
FIGS. 9A-9B show TNF-alpha production by human PBMCs activated with the indicated antibodies. A similar experimental setup as described for FIGS. 6A-6B was used.
Figure 9B:
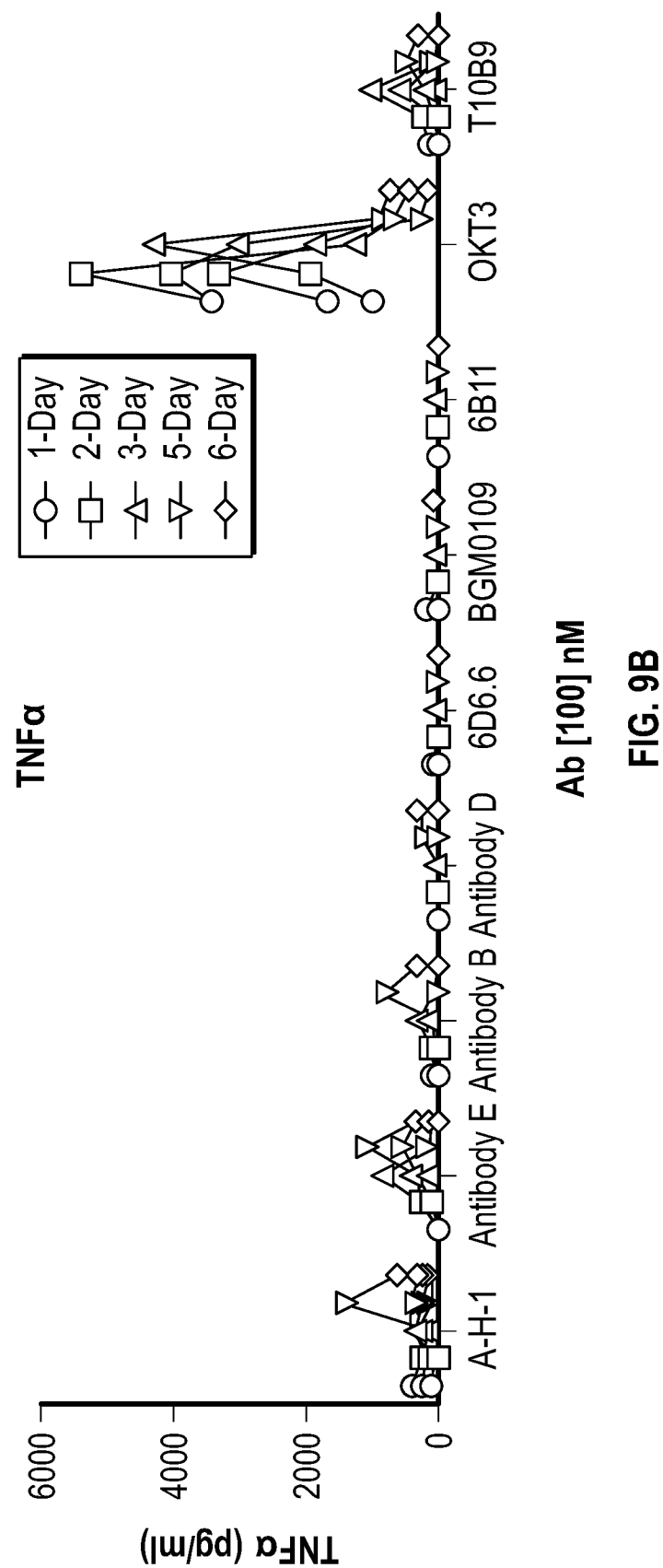
Figure 10A:
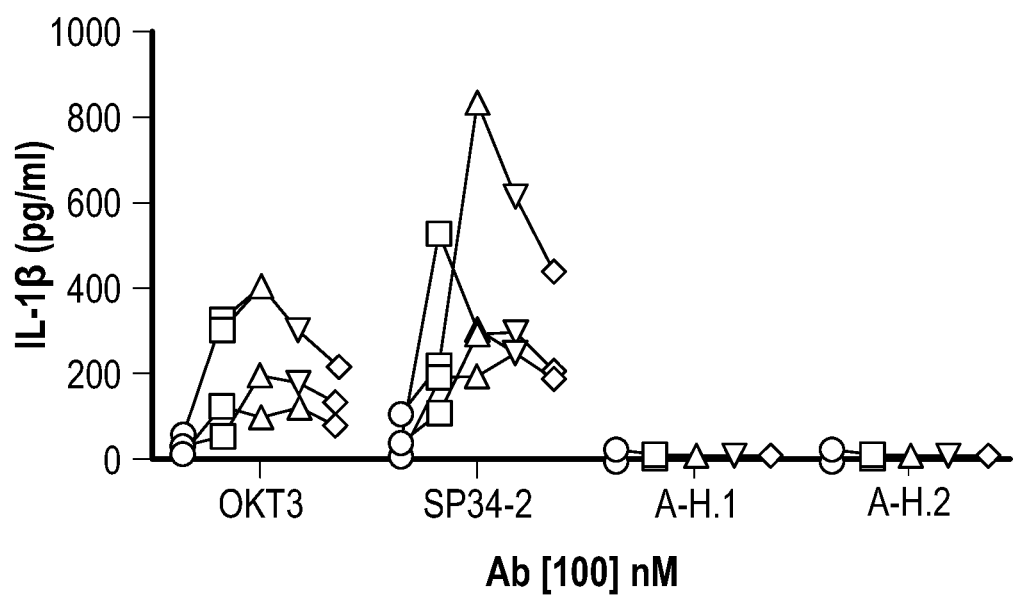
FIGS. 10A-10B show IL-1beta production by human PBMCs activated with the indicated antibodies. A similar experimental setup as described for FIGS. 6A-6B was used.
Figure 10B:
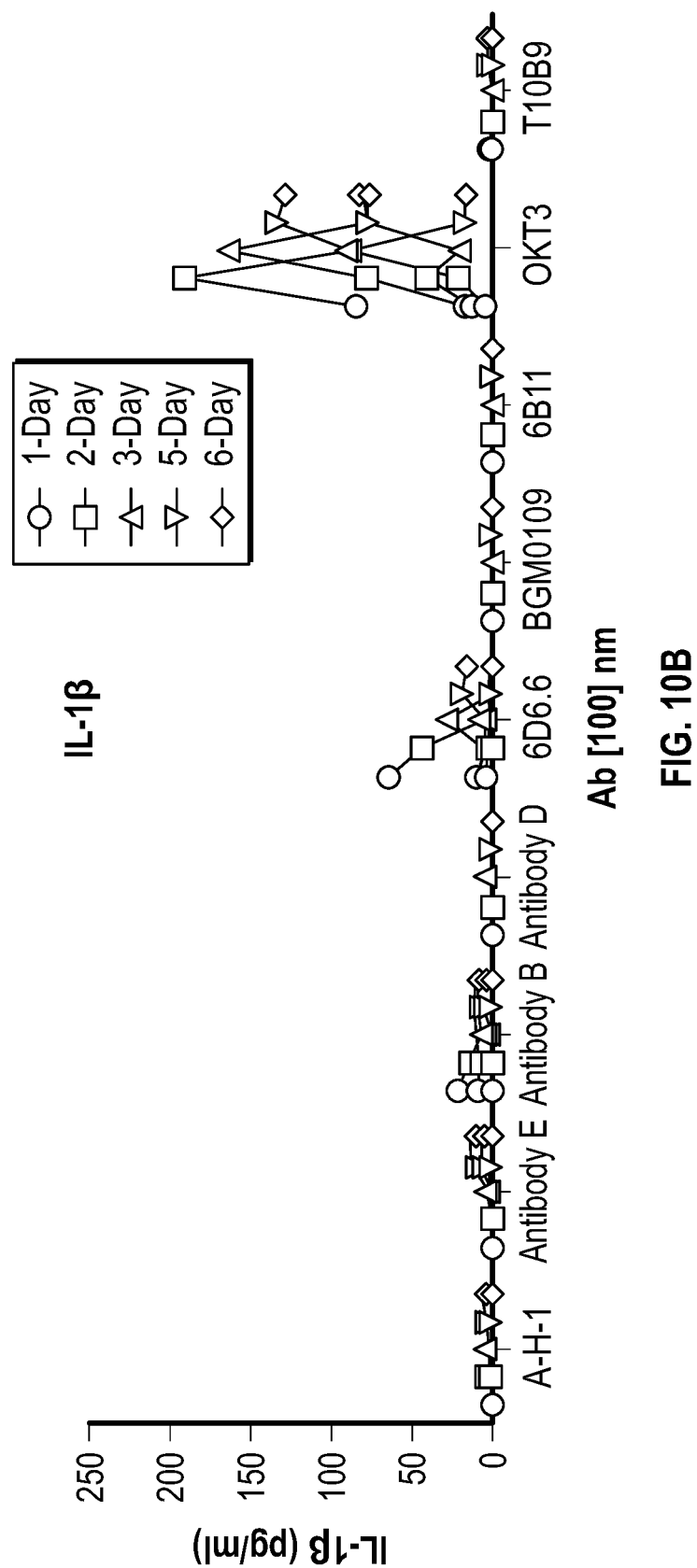

The production of cytokines IL-6, IL-10 and TNF-alpha which are associated with "cytokine storms" (and accordingly CRS) was also assessed under similar conditions. FIGS. 8A, 9A and 10A shows that while PBMCs activated with anti-CD3e antibodies demonstrate production of IL-6 (FIG. 8A), TNF-alpha (FIG. 9A) and IL-1β (FIG. 10A), no or little induction of these cytokines was observed with PBMCs activated with A-H.1 or A-H.2. As shown in FIGS. 9B and 10B, TNF-alpha and IL-1β production was not induced by activation of PBMCs with any of the anti-TCR VB antibodies.

Figure 11A:
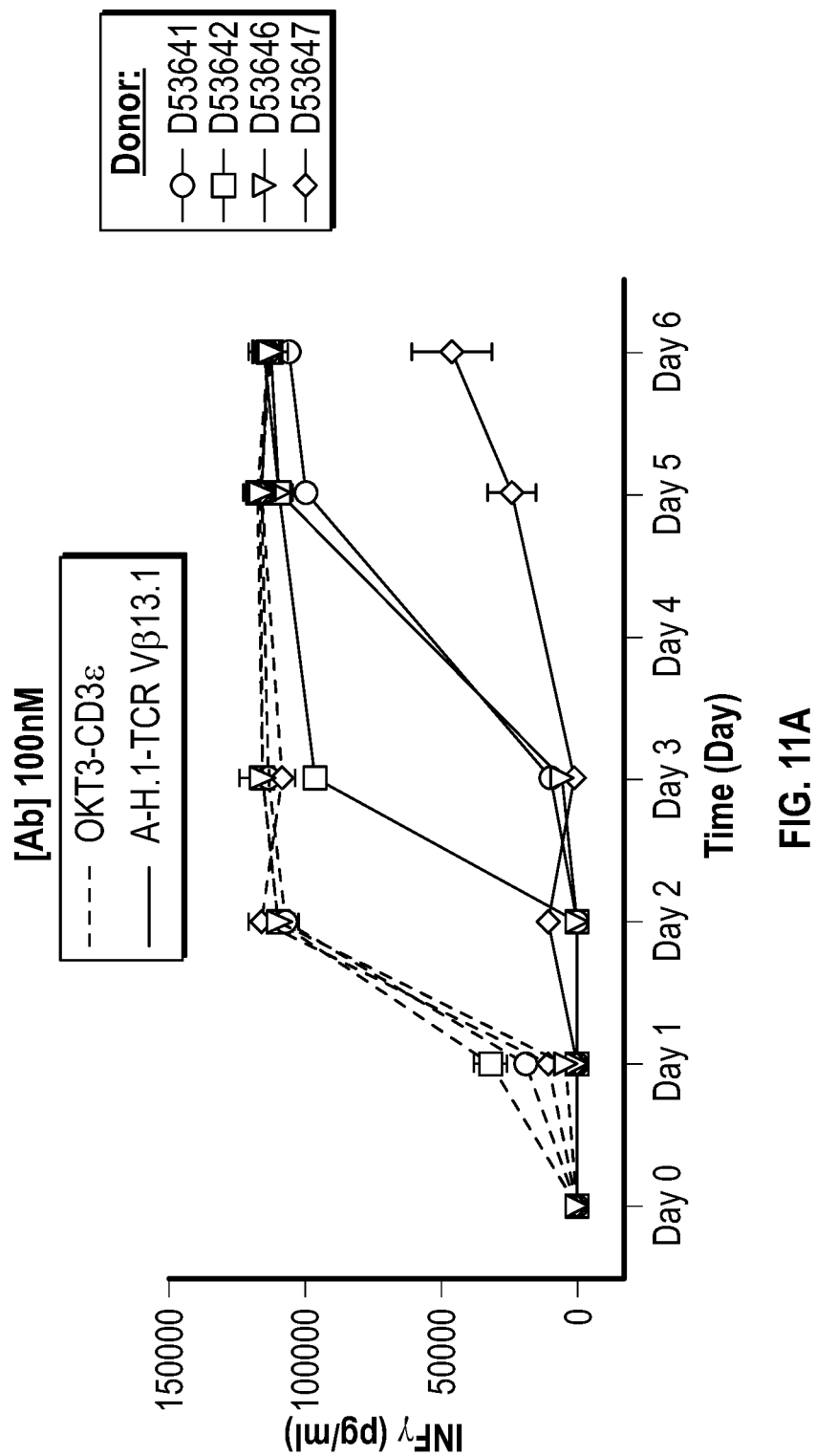
FIGS. 11A-11B are graphs showing delayed kinetics of IFNg secretion in human PMBCs activated by anti-TCR Vβ13.1 antibody A-H.1 when compared to PBMCs activated by anti-CD3e antibody OKT3.
Figure 11B:
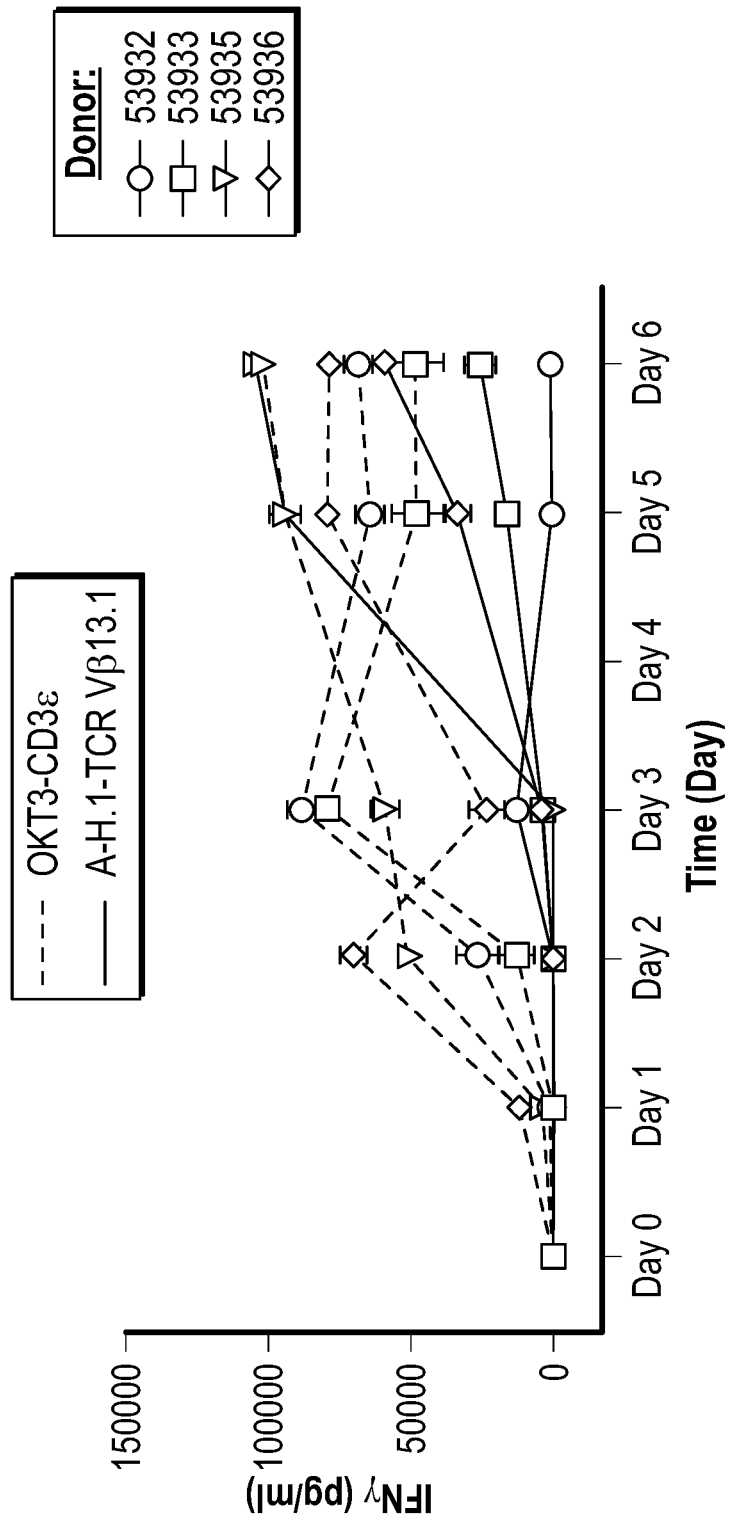

It was further noted that the kinetics of IFNg production by A-H.1-activated CD3+ T cells was delayed relative to those produced by CD3+ T cells activated by anti-CD3e mAbs (OKT3 and SP34-2) (FIGS. 11A and 11B).

Figure 12:
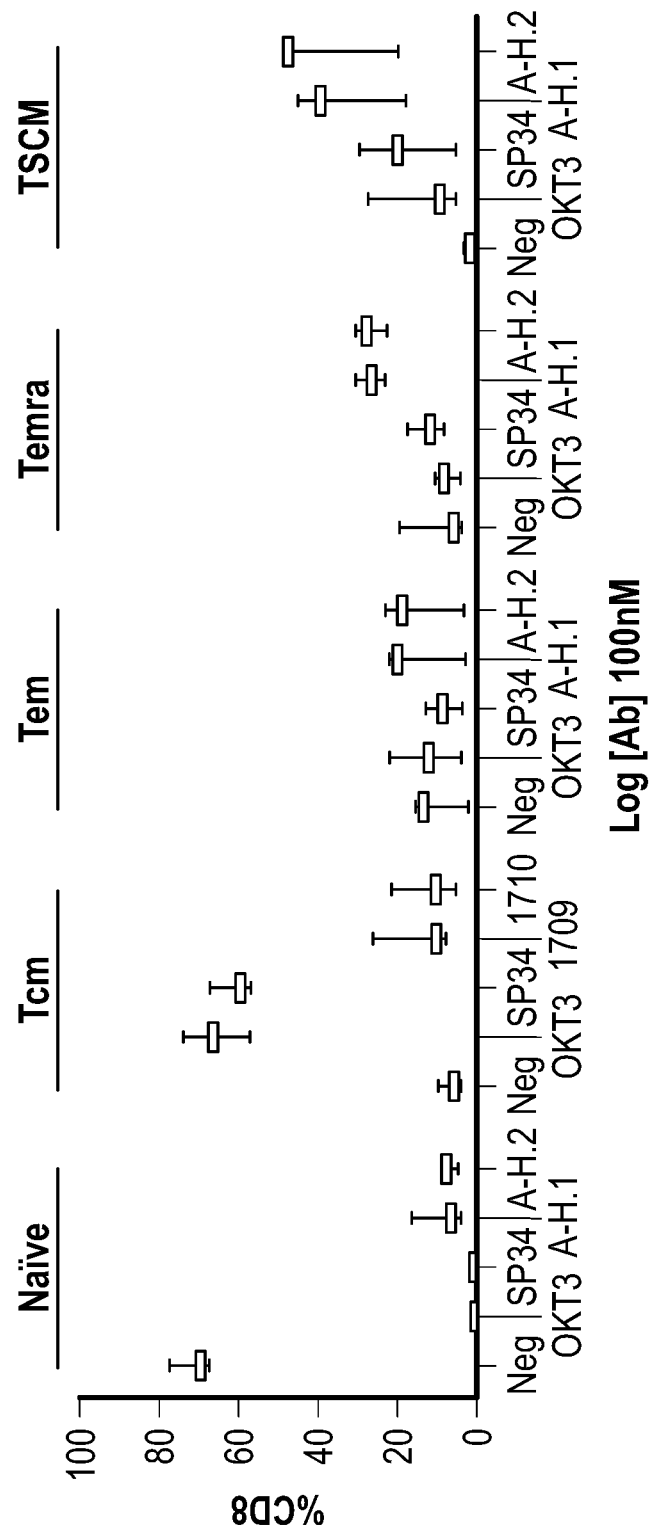
FIG. 12 depicts increased CD8+ TSCM and Temra T cell subsets in human PBMCs activated by anti-TCR Vβ13.1 antibodies (A-H.1 or A-H.2) compared to PBMCs activated by anti-CD3e antibodies (OKT3 or SP34-2).

Finally, it was observed that the subset of memory effector T cells known as $T_{EMRA}$ was preferentially expanded in CD8+ T cells activated by A-H.1 or A-H.2 (FIG. 12). Isolated human PBMCs were activated with immobilized (plate-coated) anti-CD3e or anti-TCR Vβ13.1 at 100 nM for 6-days. After a 6-day incubation, T-cell subsets were identified by FACS staining for surface markers for Naive T cell (CD8+, CD95-, CD45RA+, CCR7+), T stem cell memory (TSCM; CD8+, CD95+, CD45RA+, CCR7+), T central memory (Tcm; CD8+, CD95+, CD45RA-, CCR7+), T effector memory (Tem; CD8+, CD95+, CD45RA-, CCR7-), and T effector memory re-expressing CD45RA (Temra; CD8+, CD95+, CD45RA+, CCR7-). Human PBMCs activated by anti-TCR Vβ13.1 antibodies (A-H.1 or A-H.2) increased CD8+ TSCM and Temra T cell subsets when compared to PBMCs activated by anti-CD3e antibodies (OKT3 or SP34-2). Similar expansion was observed with CD4+ T cells.

Conclusion

The data provided in this Example show that antibodies directed against TCR Vb can, e.g., preferentially activate a subset of T cells, leading to an expansion of $T_{EMRA}$, which can, e.g., promote tumor cell lysis but not CRS. Thus, bispecific constructs utilizing either a Fab or scFV or a peptide directed to the TCR Vb can, e.g., be used to activate and redirect T cells to promote tumor cell lysis for cancer immunotherapy, without, e.g., the harmful side-effects of CRS associated with anti-CD3e targeting.

Example 4: On-Target T Cell Mediated Cytotoxicity of Multiple Myeloma (MM) Cells with a Dual-Targeting Antibody Molecule Against BCMA and a T Cell Engager This example shows on-target T cell mediated cytotoxicity of multiple myeloma (MM) cells with dual-targeting antibody molecules that recognize a T cell engager, e.g., TCRVb, on T cells and BCMA on MM cells.

Figure 13A:
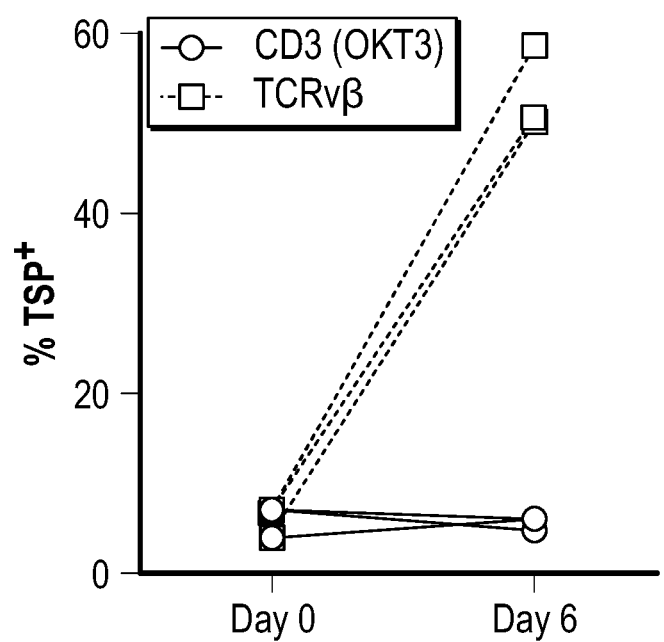
FIGS. 13A-13F show characterization of an anti-TCRVb antibody.
Figure 13B:
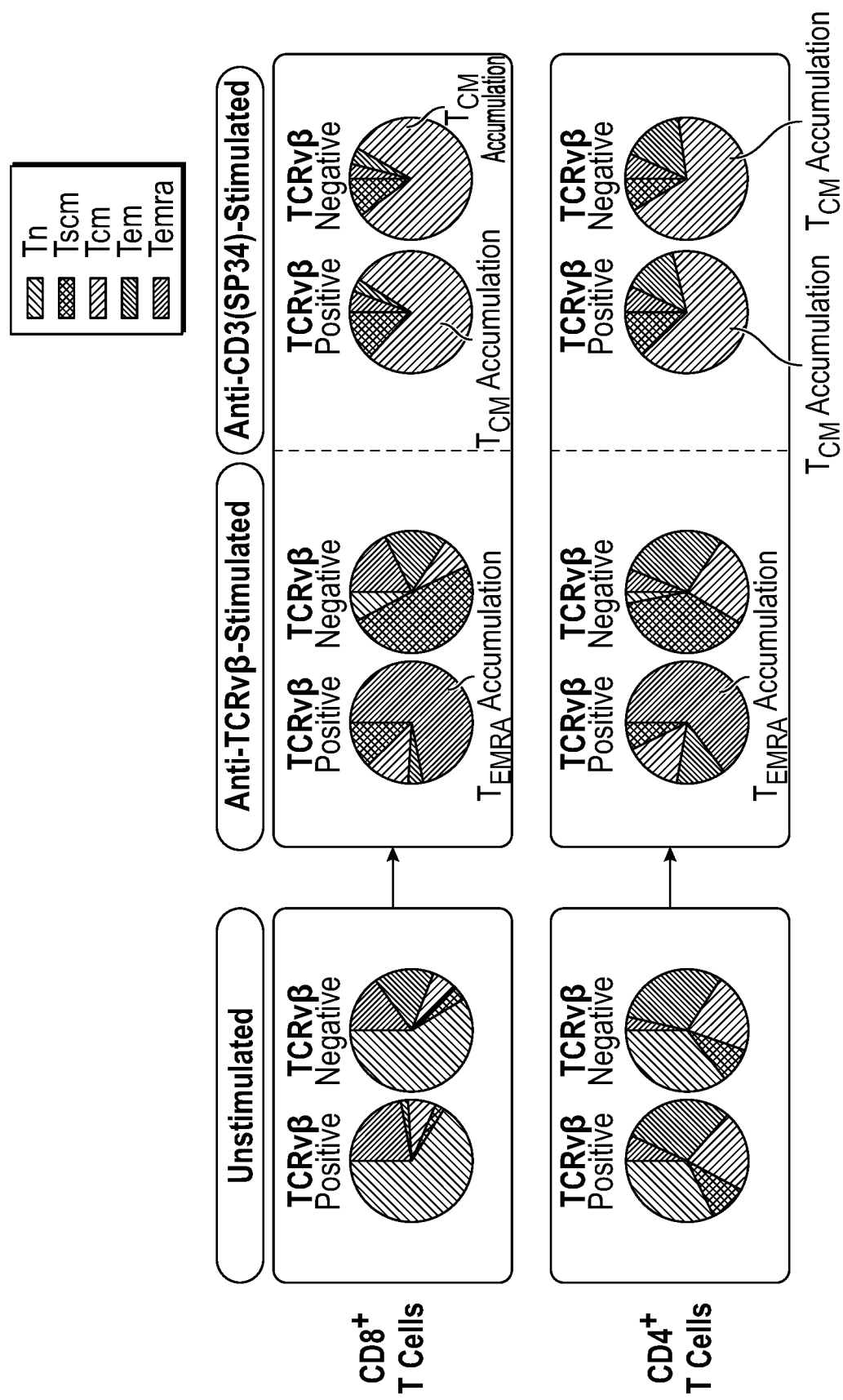
Figure 13C:
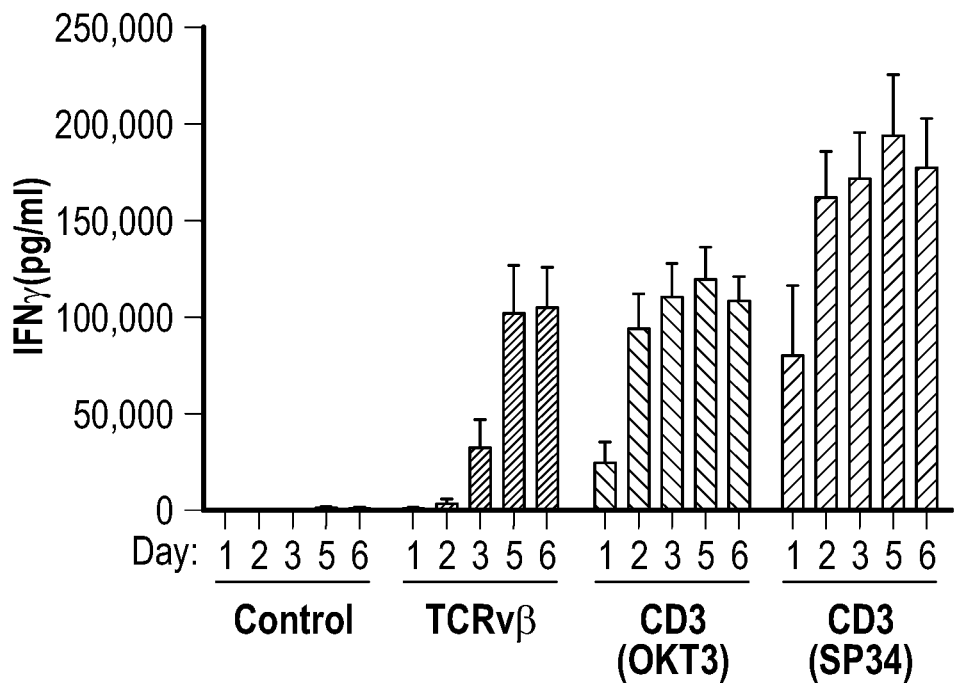
Figure 13D:
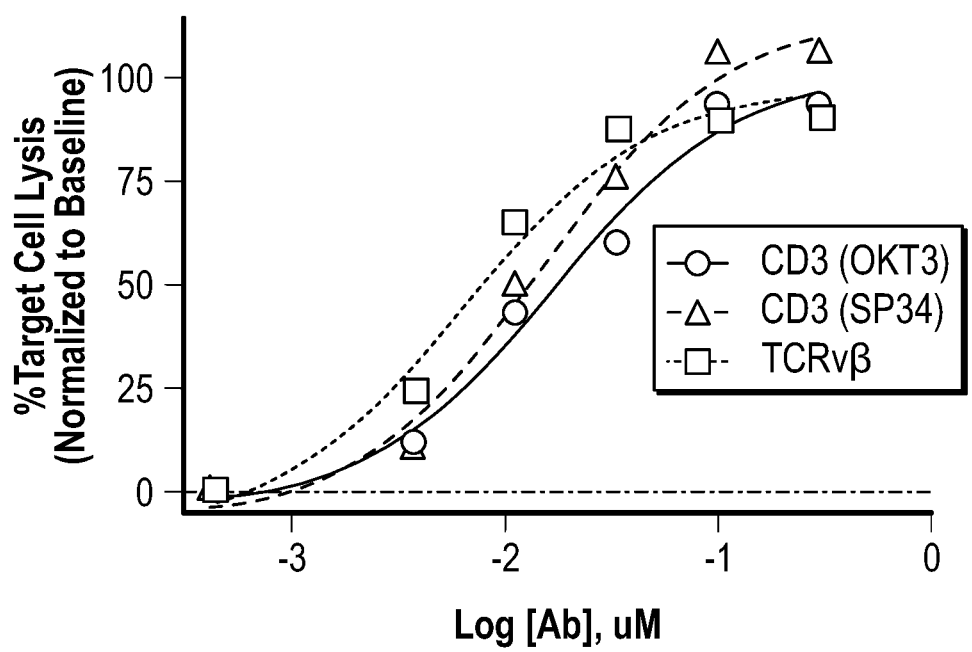
Figure 13E:
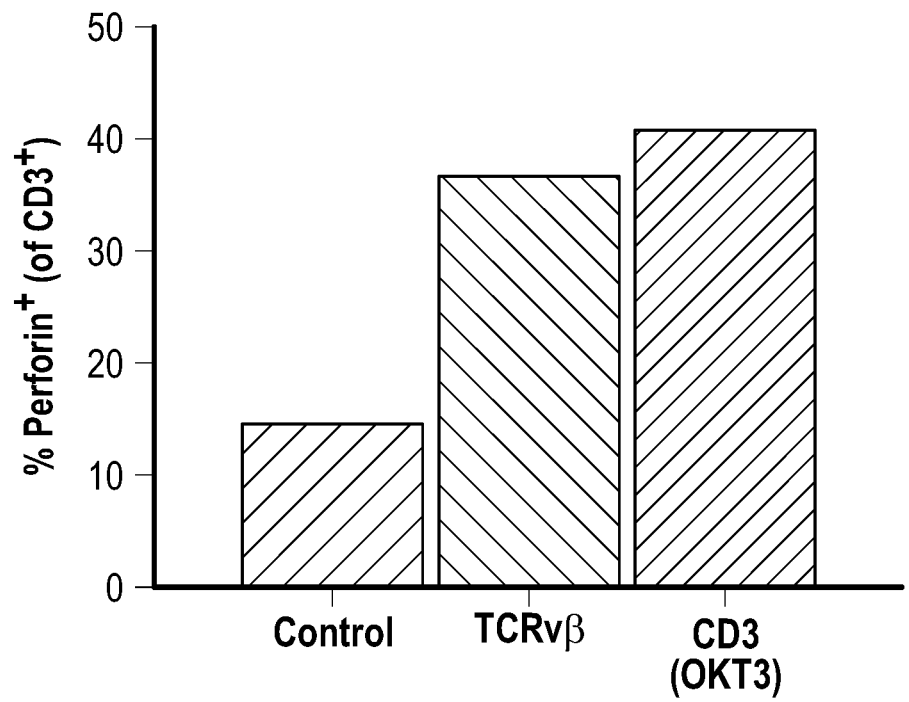
Figure 13F:
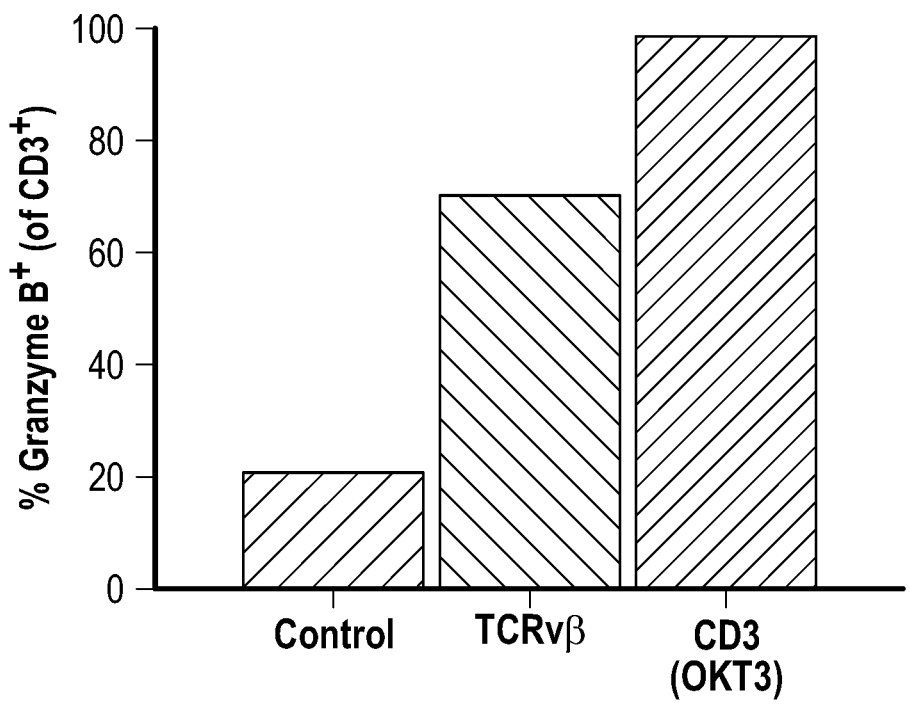

As shown in FIG. 13A, purified human T cells activated with plate-bound anti-TCRVb antibody for 5 days proliferate at a higher rate than purified human T cells activated with plate-bound anti-CD3 (OKT3) antibody. Anti-TCRVb antibody stimulation of T cells resulted in selective expansion of CD45RA+ effector memory CD8+ and CD4+ T cells ($T_{EMRA}$) cells (FIG. 13B). Both CD8+ and CD4+ Temra cell populations expanded more when stimulated with an anti-TCRVb antibody, compared to unstimulated cells or cells stimulated with an anti-CD3(SP34) antibody. Anti-TCRVb antibodies resulted in delayed secretion of IFN-g by PBMCs stimulated with an anti-TCRVb antibody compared to PBMCs stimulated with anti-CD3 antibodies (FIG. 13C). Additionally, T cells stimulated with anti-TCRVb antibody or anti-CD3 antibodies resulted in comparable lysis of multiple myeloma target cells, as shown in FIG. 13D. As shown in FIGS. 13E-13F, T cells stimulated for 5 days with 100 ng/ml plate-bound an anti-TCRVb antibody, or an anti-CD3 antibody secreted perforin and Granzyme B.

Figure 14B:
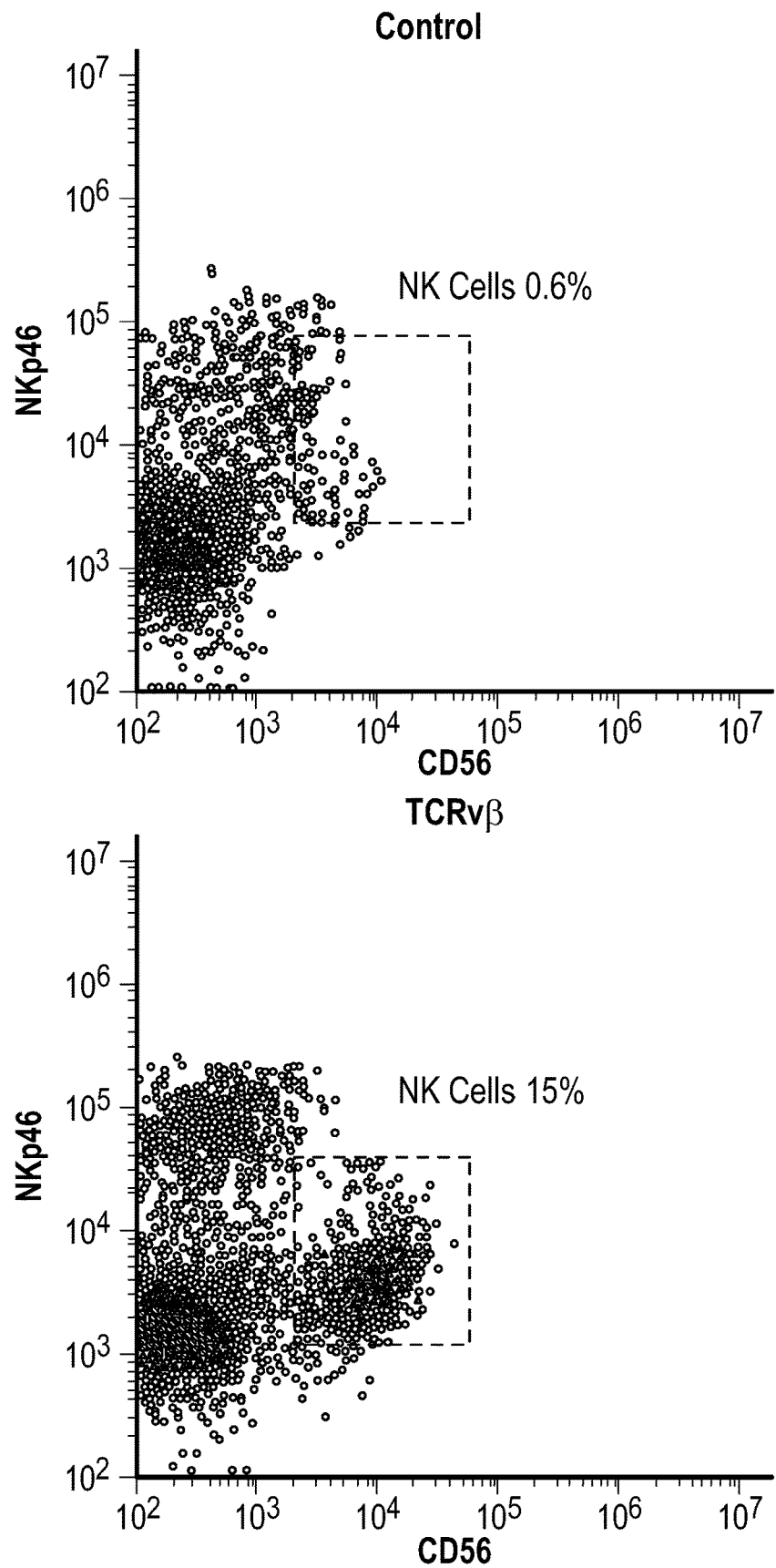
Figure 14B:
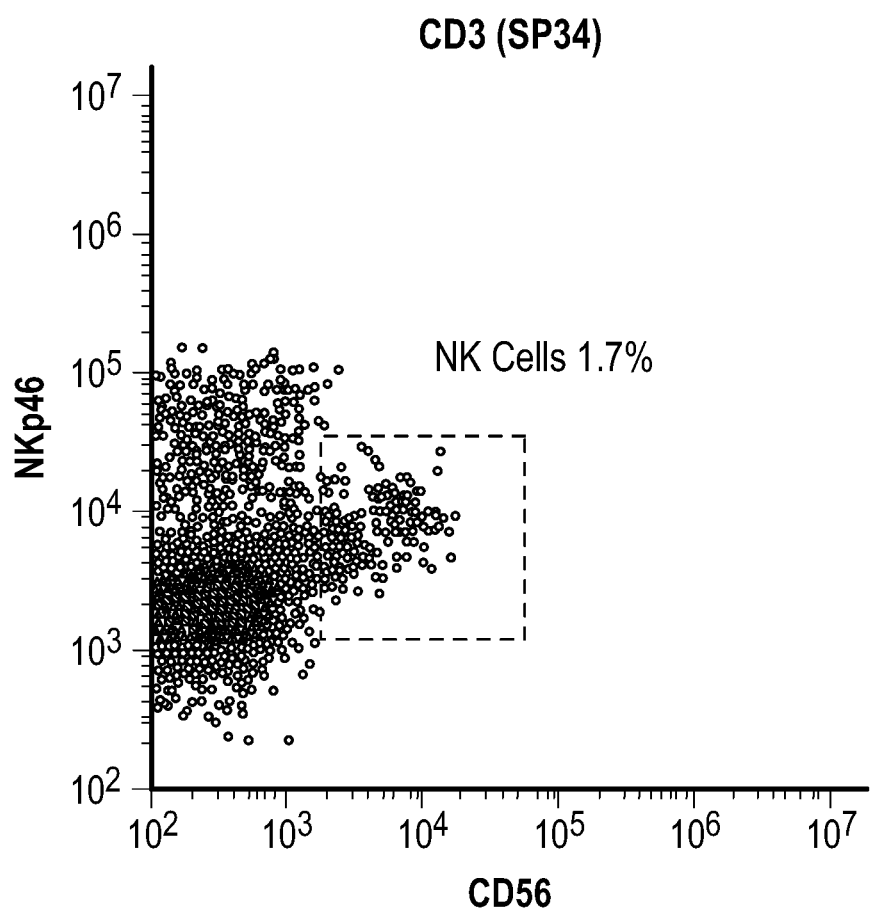
Figure 15A:
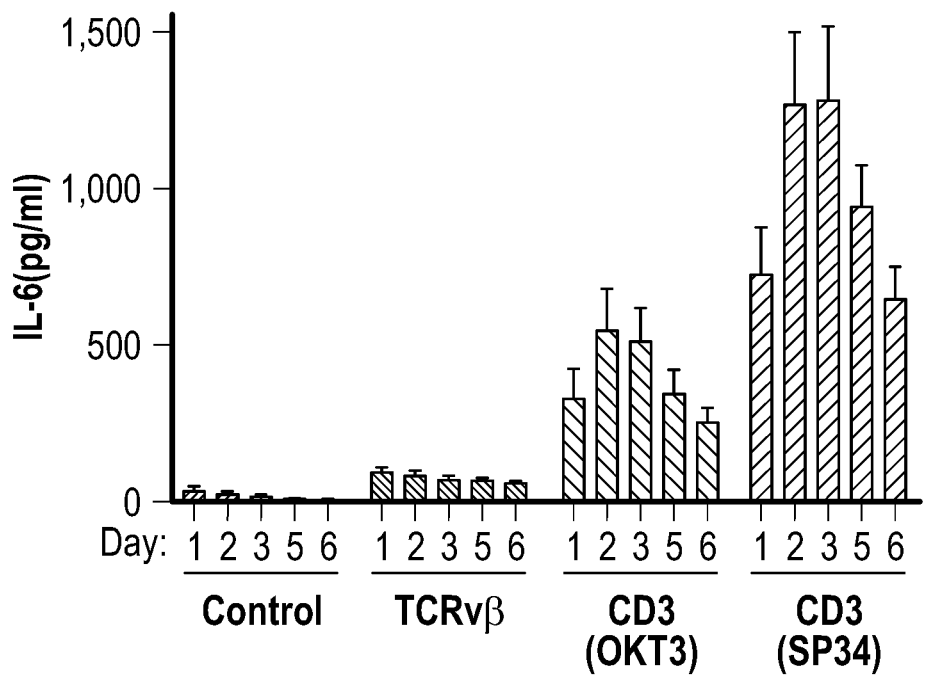
FIGS. 15A-15C show secretion of cytokines in PBMCs stimulated with an anti-TCRVb antibody, or anti-CD3 antibodies.
Figure 15B:
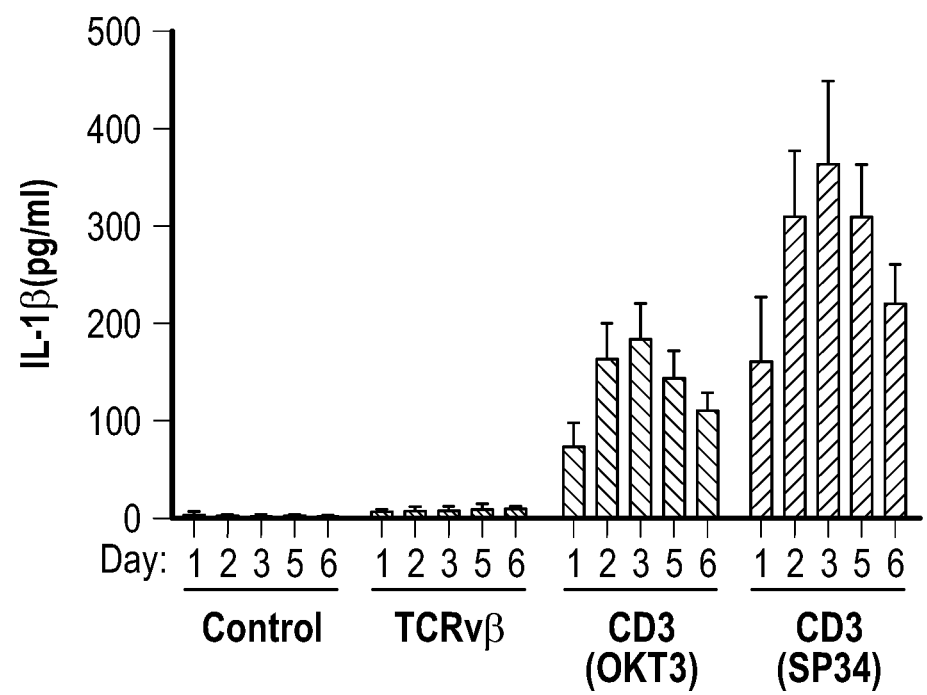
Figure 15C:
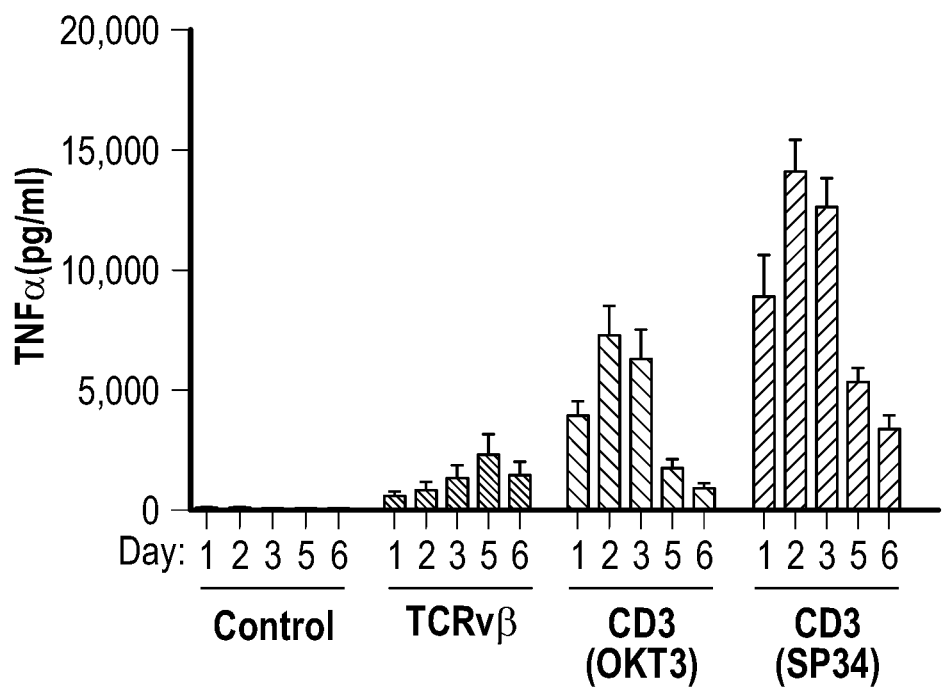

Activation of PBMCs with anti-TCRVb antibody resulted in higher production and/or secretion of IL-2 and/or IL-15 compared to PBMCs activated with an anti-OKT3 antibody (FIG. 14A). Anti-TCRVb antibody activated of PBMCs also resulted in expansion and/or survival, e.g., proliferation of Natural Killer (NK) cells (FIG. 14B). In comparison, PBMCS activated with an anti-OKT3 antibody did not result in NK cell expansion. Further, as described in Example 3, PBMCs activated with an anti-TCRVb antibody did not result in the production of cytokines IL-6, IL-1β and TNF-alpha which are associated with CRS (FIG. 15). These in vitro characterization studies show that in some embodiments, anti-TCRVb antibodies, e.g., activate and/or stimulate, T cells to promote T cell killing as evidenced by target cell lysis, perforin secretion and granzyme B secretion, and secretion of IFN-g with, e.g., delayed kinetics.

Figure 16A:
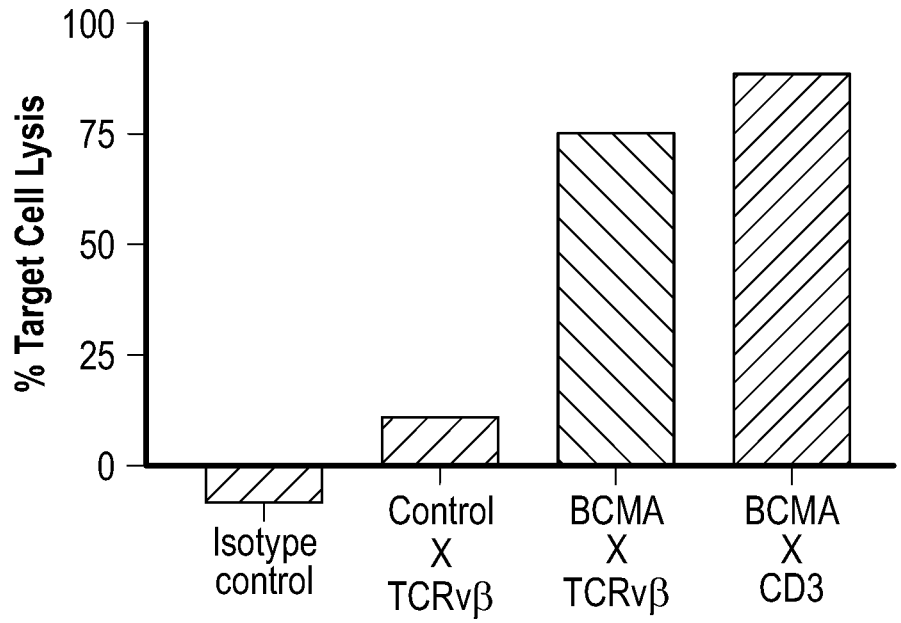
FIGS. 16A-16B show killing of MM cells by dual targeting BCMA-TCRvb antibody molecules.

Next, the ability of a dual-targeting antibody molecule (Molecule I), which targets BCMA on one arm and TCRVb on the other arm, to target and kill multiple myeloma (MM) cells was tested. Healthy donor PBMCs were co-incubated with the RMPI8226 MM cell line and one of the following dual-targeting antibody molecules: BCMA-TCRVb (Molecule I), BCMA-CD3, or Control-TCRVb; or an isotype control Target cell lysis was then assessed using flow cytometry. As shown in FIG. 16A, the dual-targeting BCMA-TCRVb antibody molecule (Molecule I) resulted in killing of MM cells in vitro.

Figure 16B:
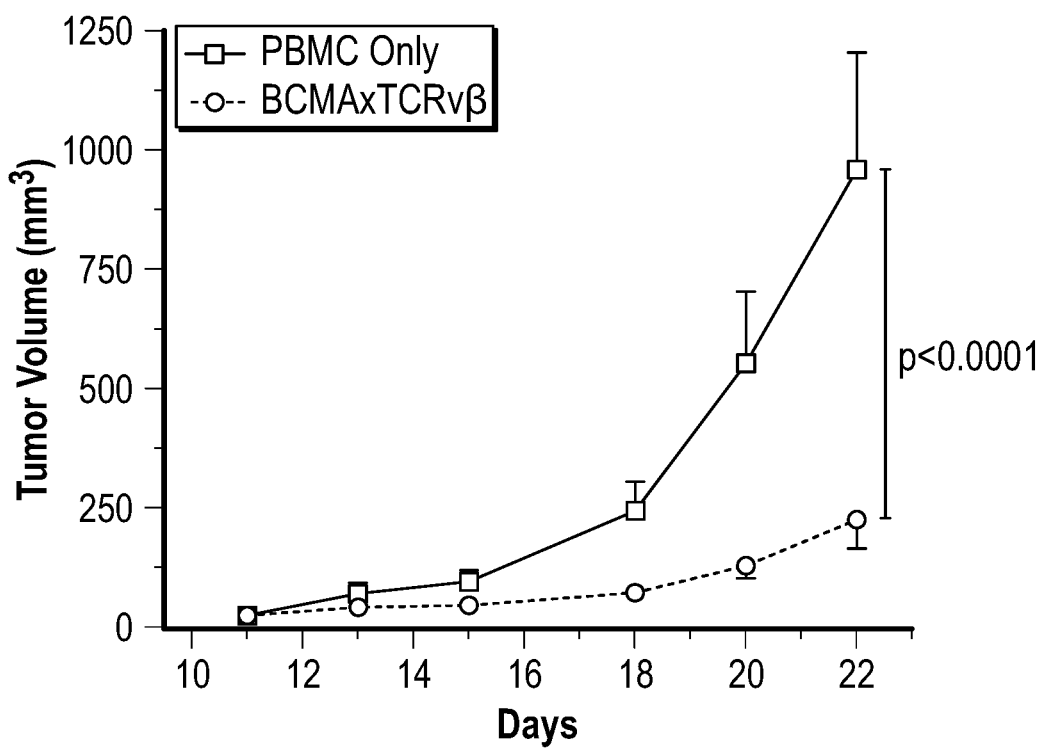

The dual-targeting BCMA-TCRVb antibody molecule (Molecule I) was further tested in vivo for its ability to inhibit MM tumor growth in a MM mouse model. The NCI-H929 cell line was injected in NOD-scid IL2rγnull (NSG)recipient mice on Day 0 followed by delivery of PBMCs on Day 9. On Days 12, 15, 18 and 21, the dual-targeting BCMA-TCRVb antibody molecule (Molecule I) was administered via intraperitoneal injection at a dose of 0.5 mg/kg. FIG. 16B shows prevention, e.g., inhibition, of MM tumor growth in vivo with the dual-targeting BCMA-TCRVb antibody molecule (Molecule I). These results demonstrate that in some embodiments the dual-targeting BCMA-TCRVb antibody molecule, e.g., can kill tumor cells, e.g., MM tumor cells, in vitro and in vivo. Accordingly, in some embodiments, a dual-targeting BCMA-TCRVb antibody molecule can be used, e.g., as a therapy for cancer, e.g., a hematological cancer, e.g., MM.

Figure 17:
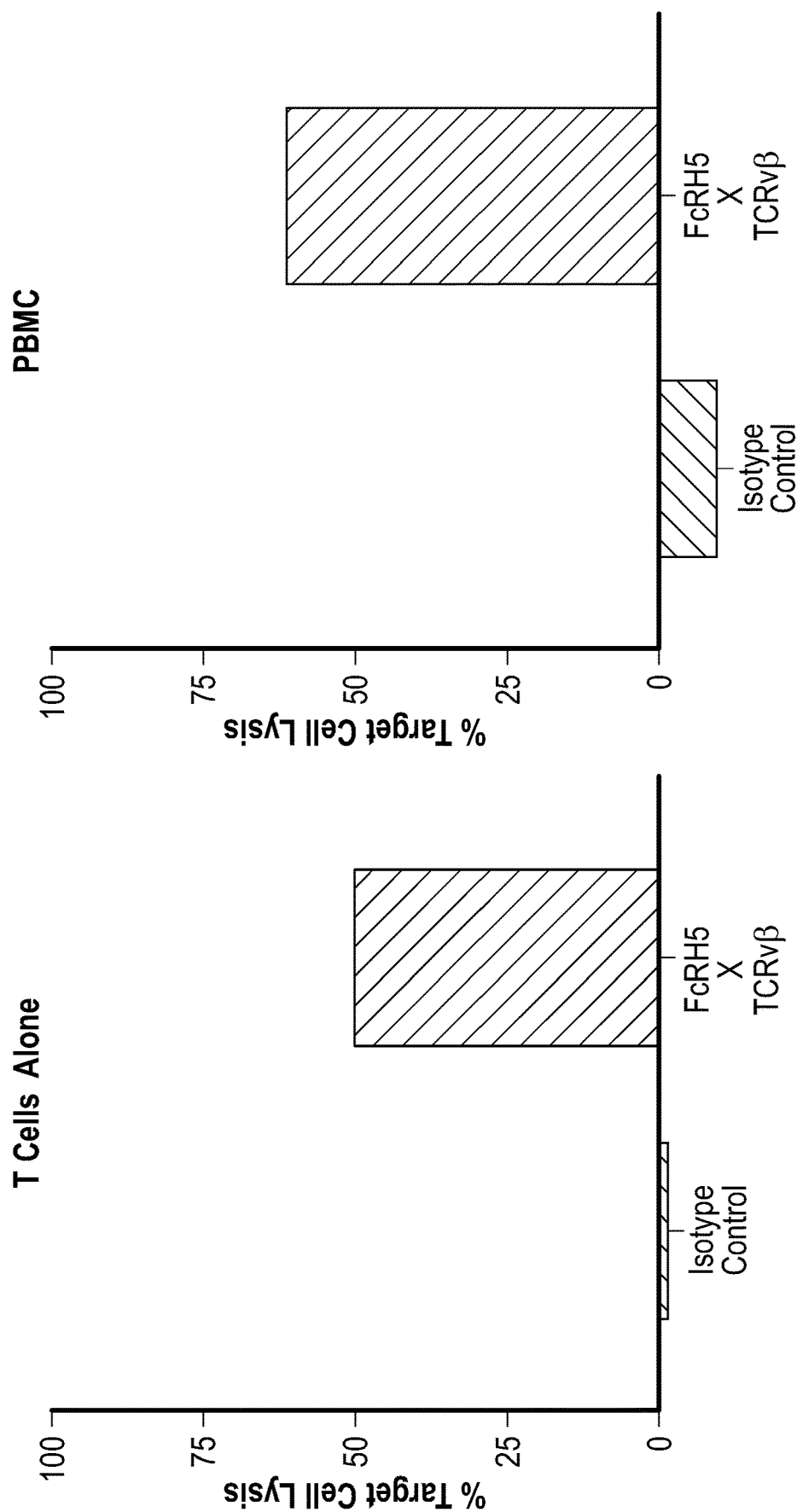
FIG. 17 shows lysis of MM target cells with a dual targeting antibody (Molecule E) which recognized FcRH5 on one arm and TCRVb on the other arm.

Example 5: In Vitro Cytotoxicity of a Dual-Targeting Antibody Molecule Against FcRH5 and a T Cell Engager This example shows in vitro cytotoxicity on multiple myeloma (MM) cells with a dual-targeting antibody molecule that recognizes a T cell engager, e.g., TCRVb, on T cells and FcRH5 on MM cells. Healthy donor PBMCs or purified T cells were co-incubated with the MOL8M MM cell line and a dual-targeting antibody molecule which targets FcRH5 on one arm and TCRVb on the other arm (Molecule E), or with an isotype control antibody. Target cell lysis was then assessed using flow cytometry. As shown in FIG. 17, the dual targeting FcRH5-TCRVb molecule (Molecule E) resulted in killing of MM cells by both purified T cells or PBMCs. This shows that the dual targeting FcRH5-TCRVb molecule can target and promote killing of MM cells by immune cells, e.g., in PBMCs, including T cells.

Example 6: Characteristics of Anti-TCR Vβ8a Antibodies

This Example shows in vitro characterization of anti-TCR Vβ8a antibodies (B-H.1). TCR Vβ8 is also referred to as TCR Vβ12 (as described in Table 8). Isolated human PBMCs were activated with immobilized (plate-coated) anti-CD3ε or anti-TCR Vβ8a at 100 nM, and cell culture supernatants were collected on day 1, 2, 3, 5, 6 and 8 post stimulation. Cytokines (IFNγ, IL-2, TNFα, IL-1(3 or IL-6) were measured using MSD technology platform (MesoScale Discovery) as described in the manufacturer's protocol.

Figure 18A:
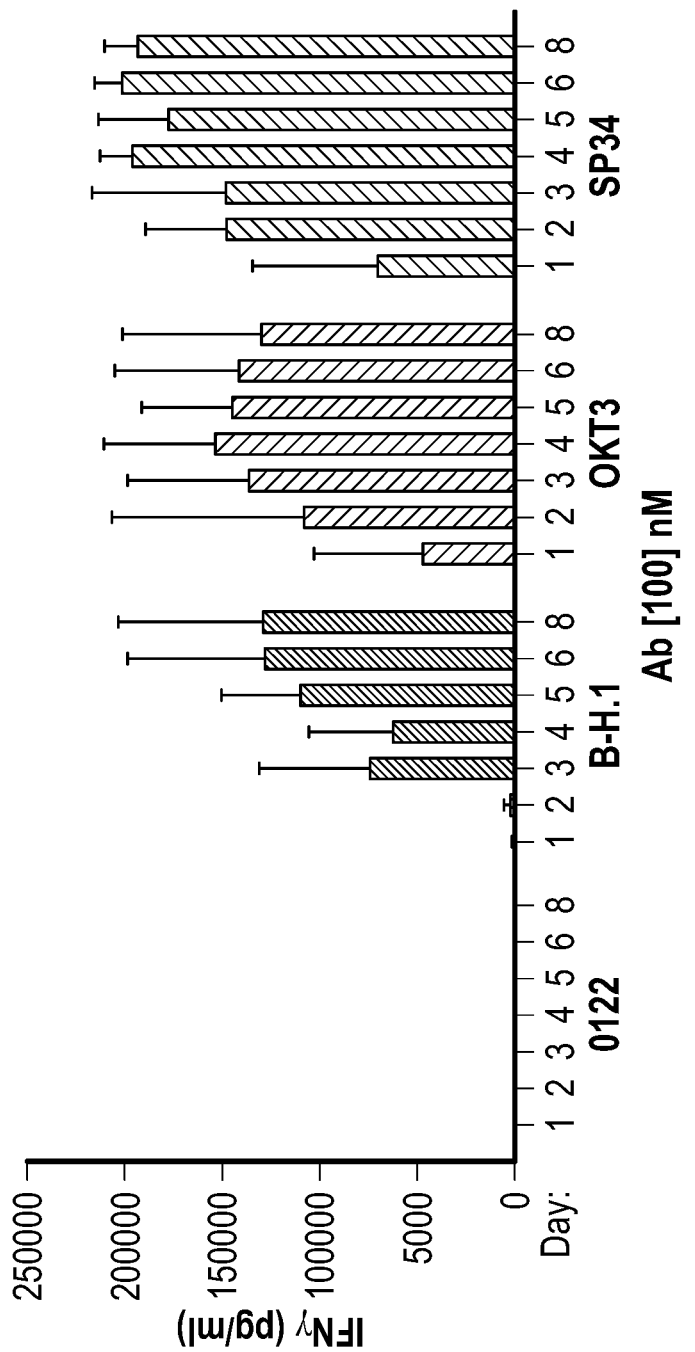
FIGS. 18A-18B demonstrate cytokine production from human PBMCs activated by anti-TCR Vβ8a antibodies (B-H.1) when compared to those activated by anti-CD3ε antibodies (OKT3 or SP34-2).
Figure 18B:
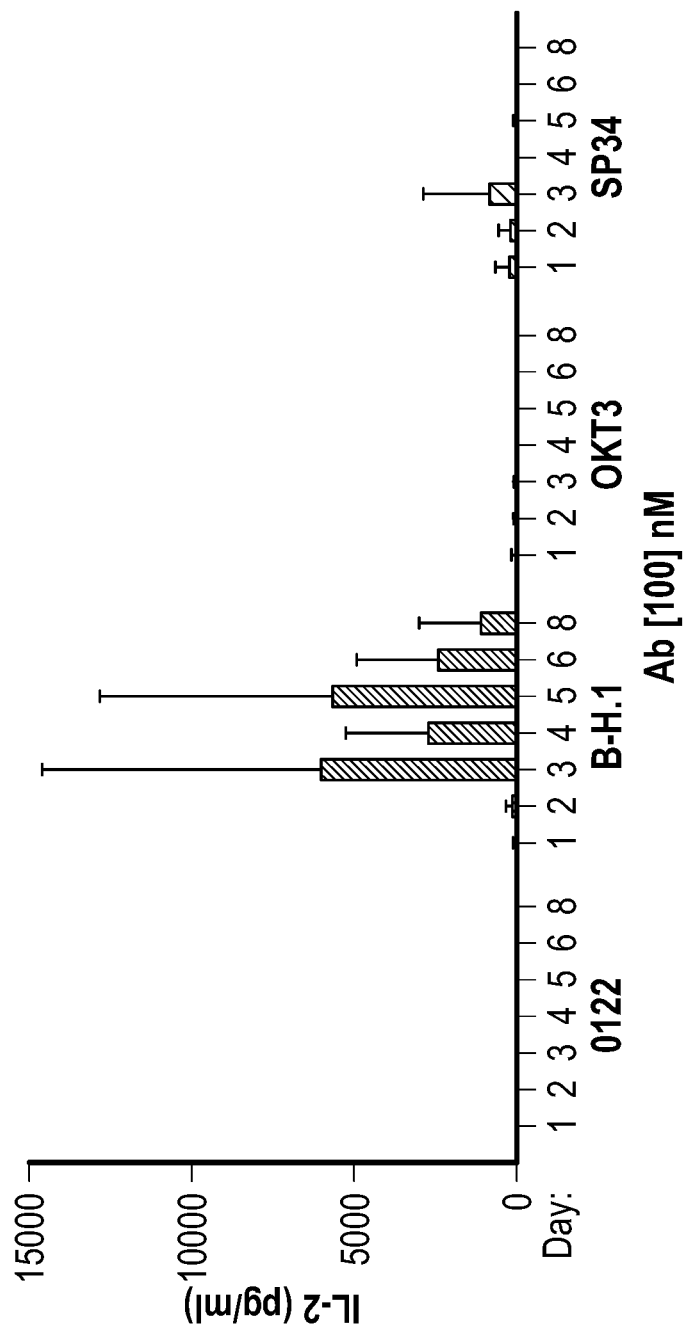

As shown in FIGS. 18A-18B, Human PBMCs activated by anti-TCR Vβ8a antibodies (B-H.1) produce similar or reduced levels of IFNγ (FIG. 18A) and higher levels IL-2 (FIG. 18B) when compared to those activated by anti-CD3ε antibodies (OKT3 or SP34-2).

Figure 19B:
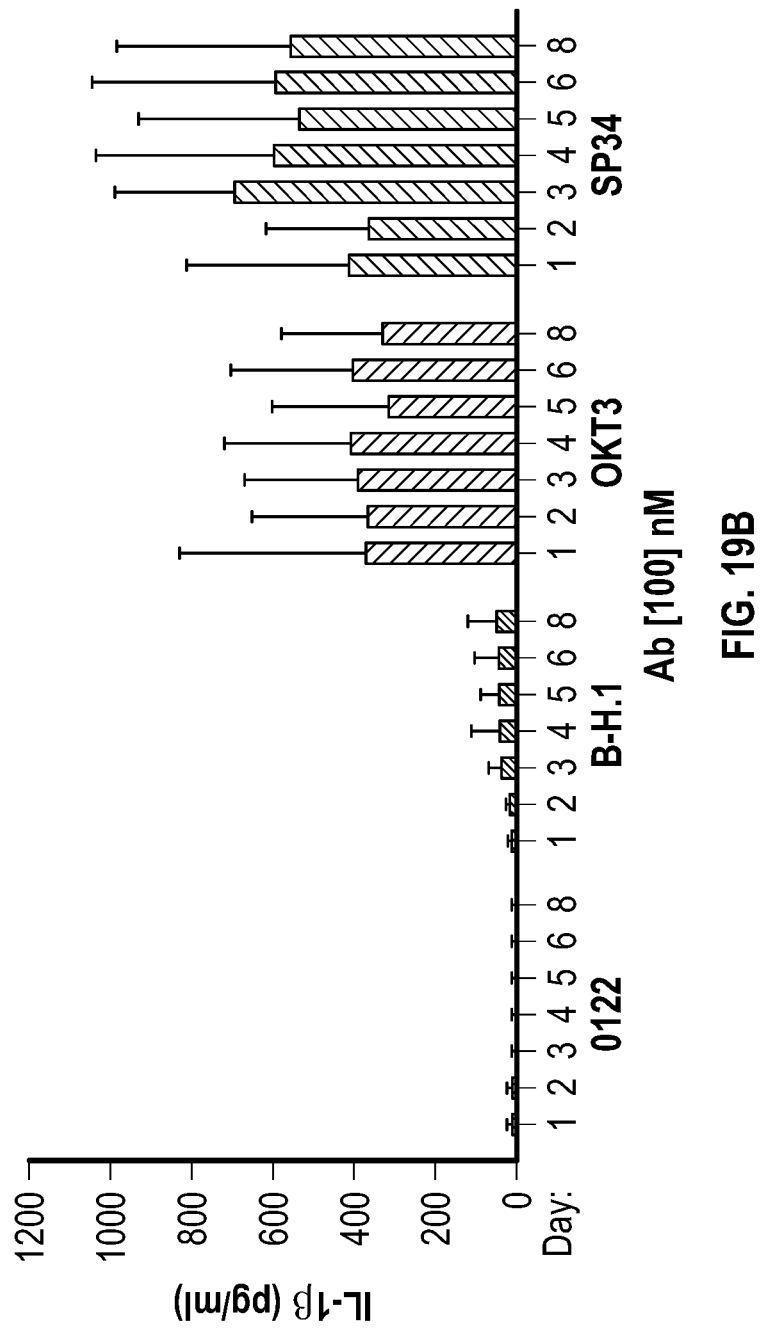

FIGS. 19A-19B show that human PBMCs activated by anti-TCR Vβ8a antibodies (B-H.1) do not produce significant levels of IL-6, or IL1b. Activation of human PBMCs with anti-TCR Vβ8a antibodies (B-H.1) also results in lesser TNFα when compared to PBMCs activated by anti-CD3ε antibodies (OKT3 or SP34-2) (see FIG. 19C).

In summary, as shown in Example 3, this Example shows that anti-TCR Vβ8a antibodies can, e.g., preferentially induce expression of T cell cytokines, e.g., IL-2 and IFNg, but not production of cytokines IL-6, IL-1β and TNF-alpha which are associated with "cytokine storms" (and accordingly CRS).

Example 7: Characteristics of Anti-TCRβV Antibody D Antibody

This Example describes characterization of anti-TCRβV antibodies which can bind and activate a subset of T cells, but with, e.g., no or markedly reduced, CRS.

Human PBMCs were isolated from whole blood followed by solid-phase (plate-coated) stimulation with anti-TCR Vβ12 antibody (Antibody D) or anti-CD3e antibodies (OKT3) at 100 nM. Supernatant was collected on Days 1, 2, 3, 5, or 6 followed by multiplex cytokine analysis for IFNg, IL-2, IL-6, IL-1beta, or TNFalpha. The data was quantified using MSD (Meso Scale Discovery) platform, following the manufacturer's protocol.

As shown in FIG. 20A, when plate-bound anti-TCR Vβ12 antibody (Antibody D) or anti-CD3e antibodies (OKT3) were used to activate human PBMCs, the T cell cytokine IFNg was induced. With respect to IL-2 production, PBMCs activated with anti-TCR V1312 antibody (Antibody D) resulted in increased IL-2 production with delayed kinetics (FIG. 20B) as compared to PBMCs activated with anti-CD3e antibodies (OKT3).

Figure 20D:
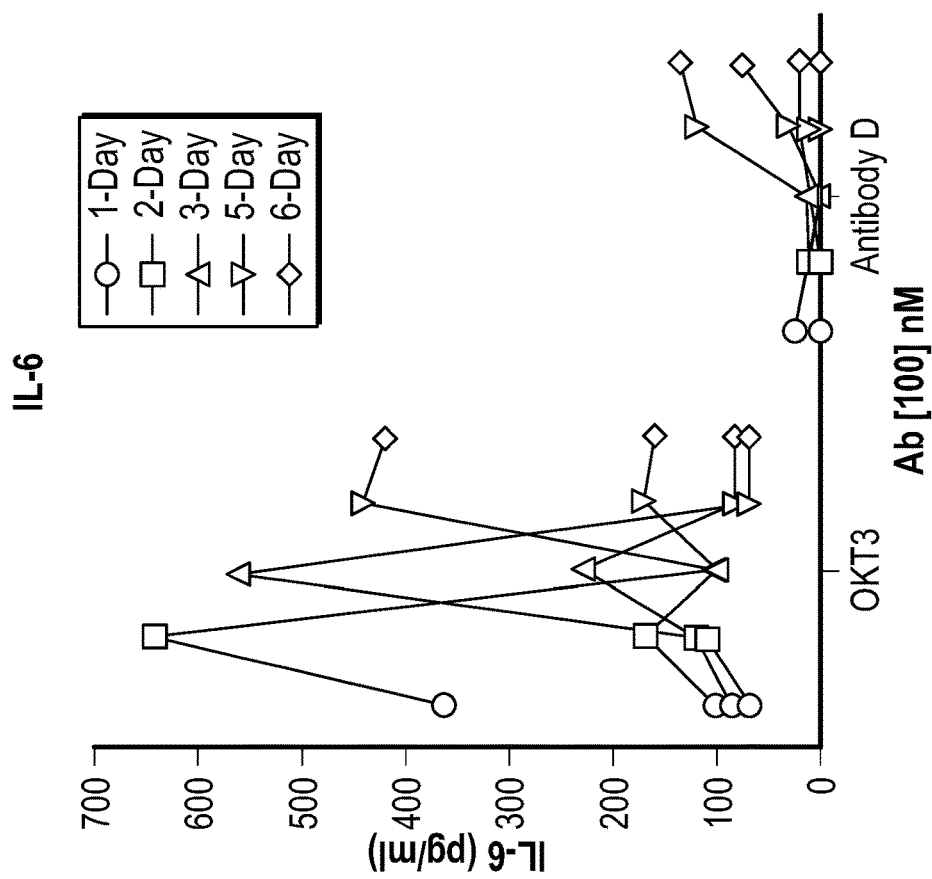
Figure 20C:
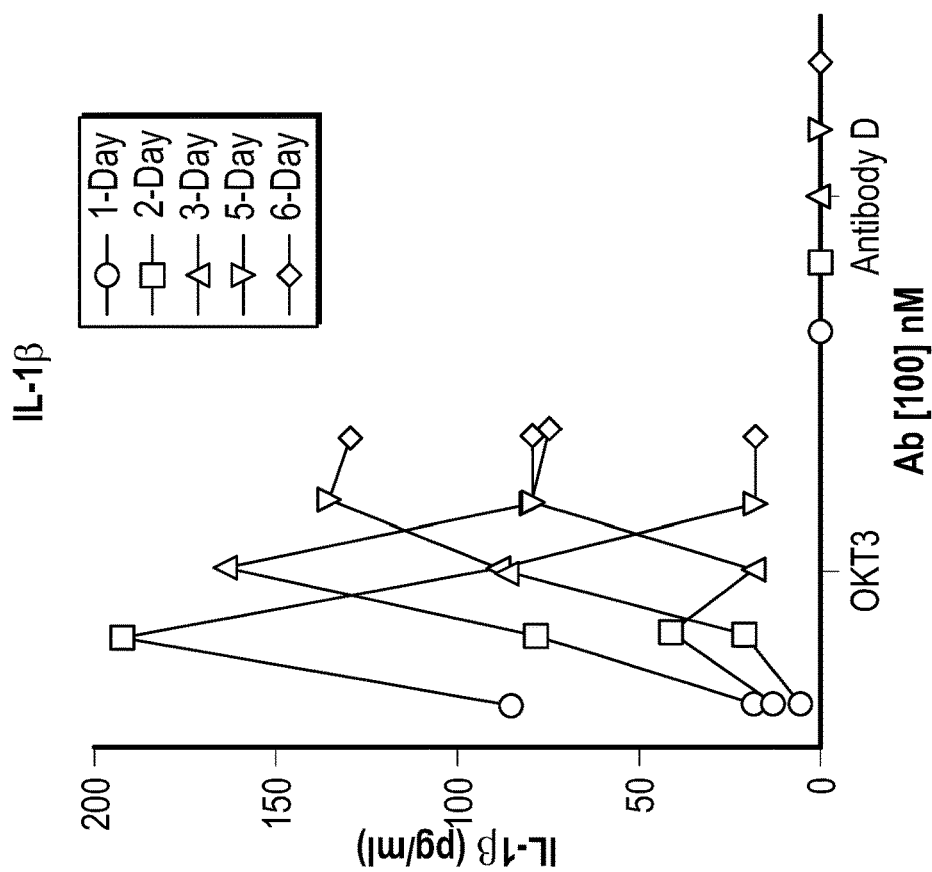
Figure 20E:
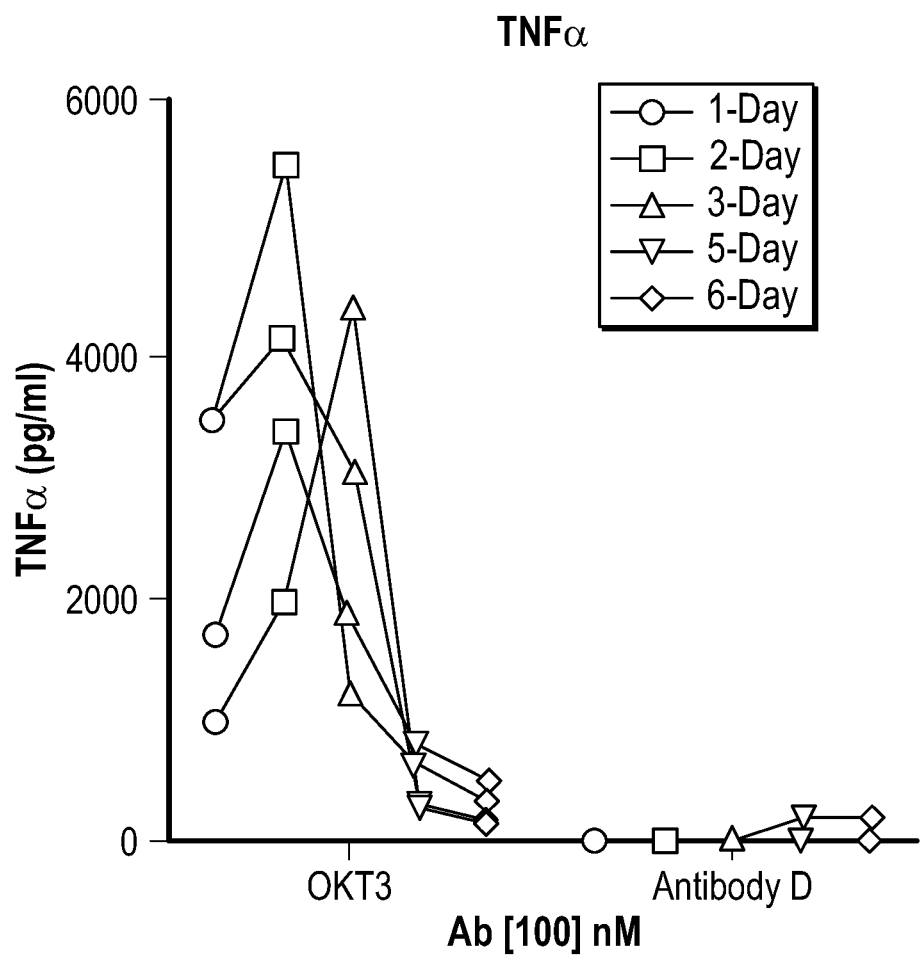

The production of cytokines IL-6, IL-10 and TNF-alpha which are associated with "cytokine storms" (and accordingly CRS) was also assessed under similar conditions. FIGS. 20C-20E show that that while PBMCs activated with anti-CD3e antibodies demonstrate production of IL-6 (FIG. 20D), TNF-alpha (FIG. 20C) and IL-1β (FIG. 20E), no or little induction of these cytokines was observed with PBMCs activated with anti-TCR V1312 antibody (Antibody D).

The data provided in this Example show that antibodies directed against TCR Vβ can, e.g., preferentially activate a subset of T cells, and do not results in induction of cytokines associated with cytokine storms or CRS.

Example 8: Characteristics of Anti-TCRβV Antibody E

This Example describes characterization of anti-TCRβV antibodies which can bind and activate a subset of T cells, but with, e.g., no or markedly reduced, CRS.

Human PBMCs were isolated from whole blood followed by solid-phase (plate-coated) stimulation with anti-TCR Vβ5 antibody (Antibody E) or anti-CD3e antibodies (OKT3 and SP34-2), each at 100 nM. Supernatant was collected on Days 1, 3, 5, or 7 followed by multiplex cytokine analysis for IFNg, IL-2, IL-6, IL-1beta, IL-10 or TNFalpha. The data was quantified using MSD (Meso Scale Discovery) platform, following the manufacturer's protocol.

Figure 21A:
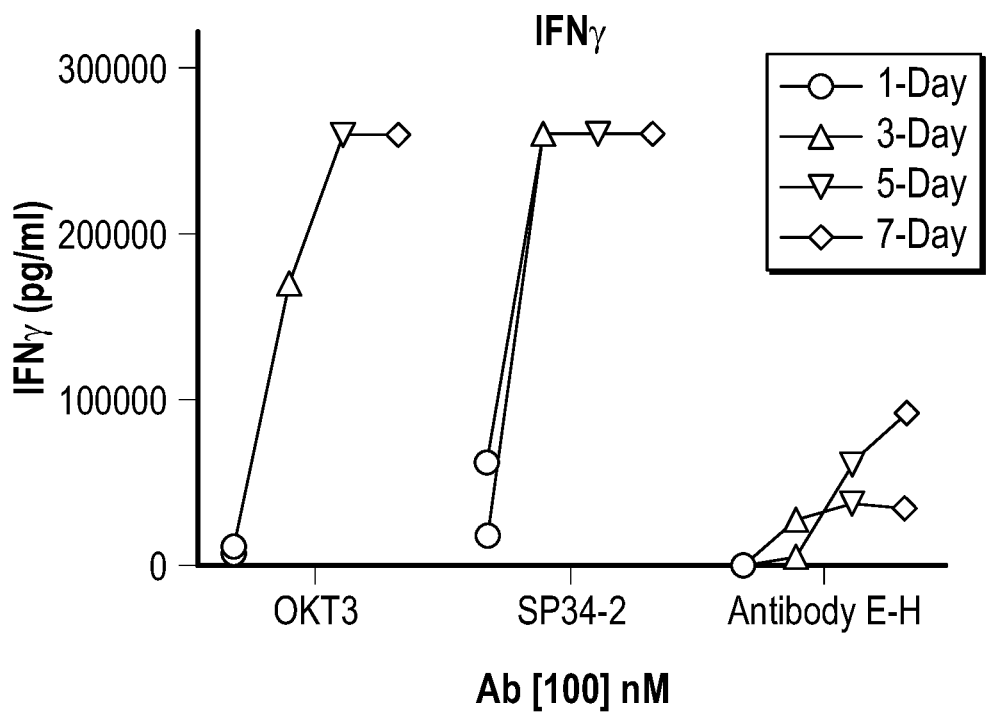
FIGS. 21A-21B demonstrate cytokine production from human PBMCs activated by anti-TCR Vβ5 antibody (Antibody E).
Figure 21B:
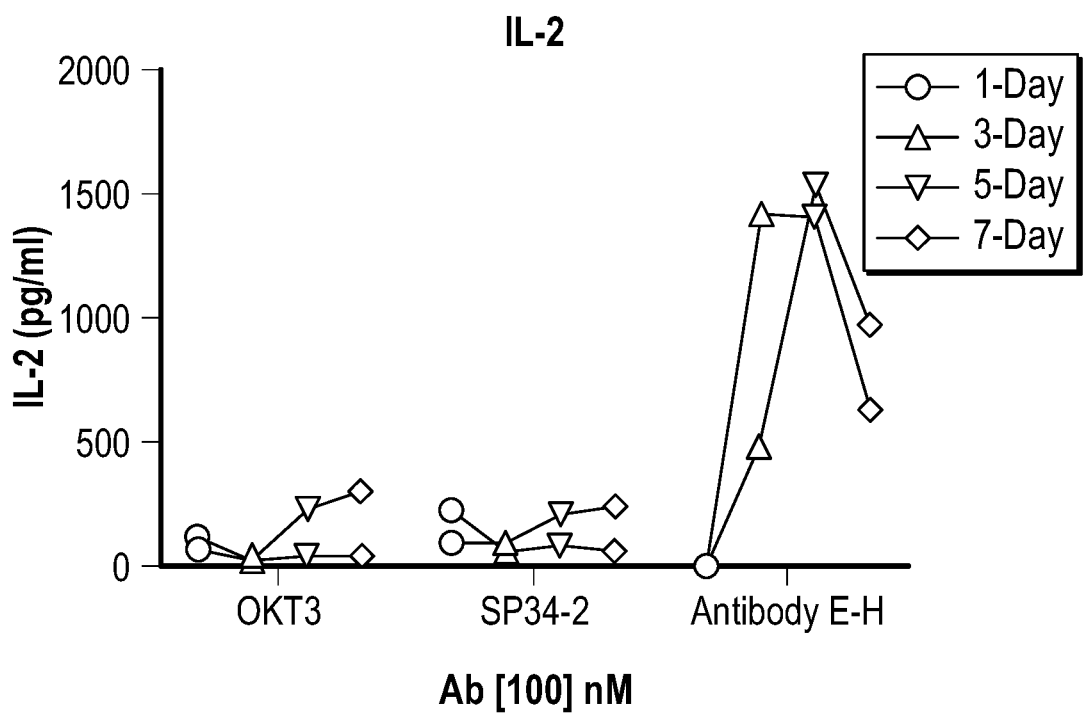
Figure 22A:
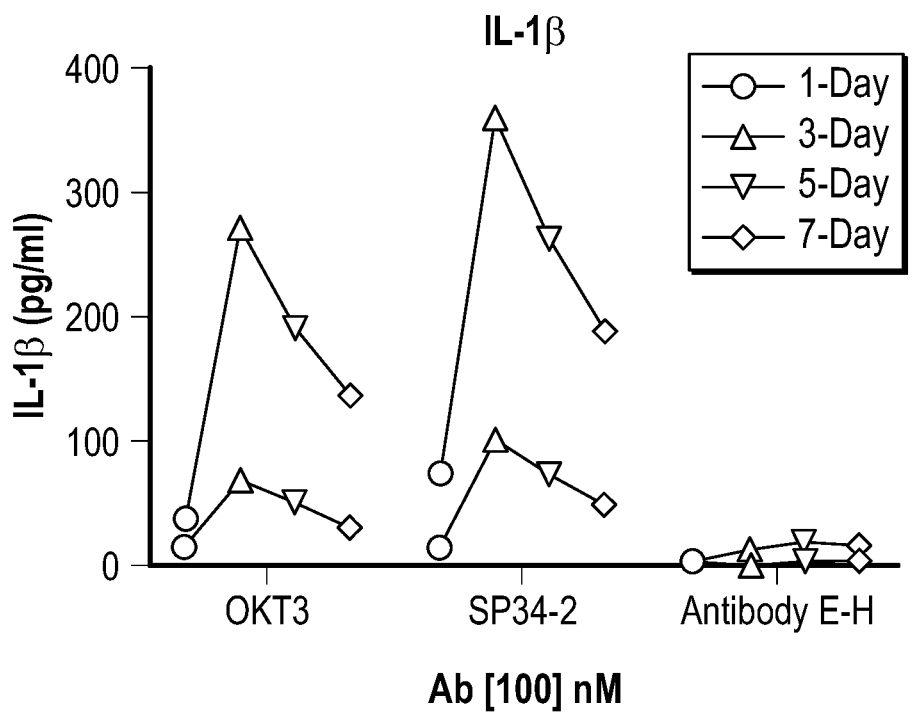
Figure 22B:
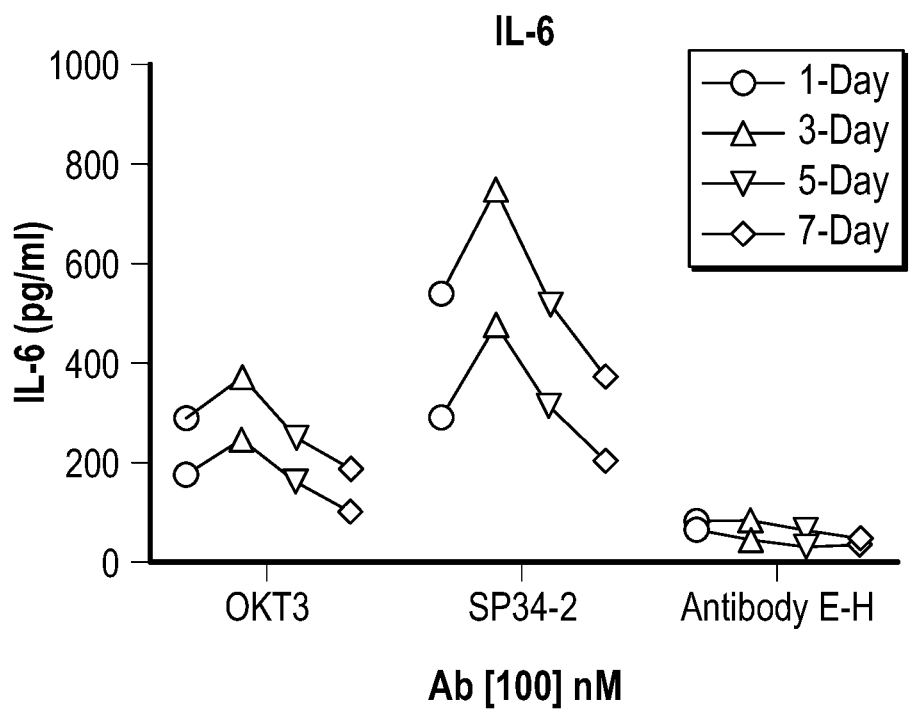
Figure 22C:
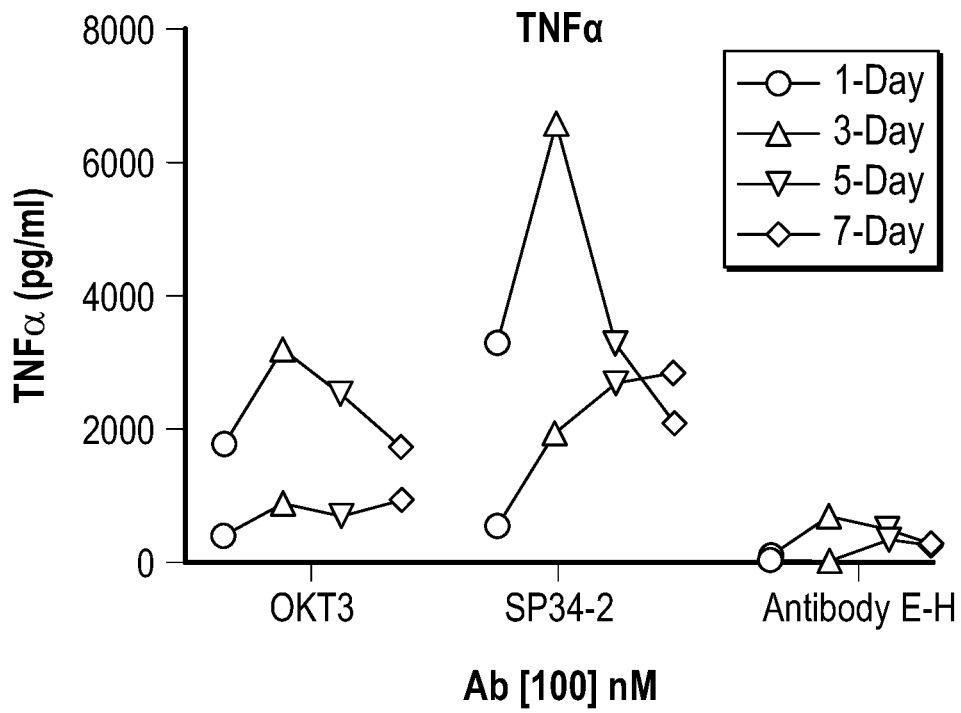
Figure 22D:
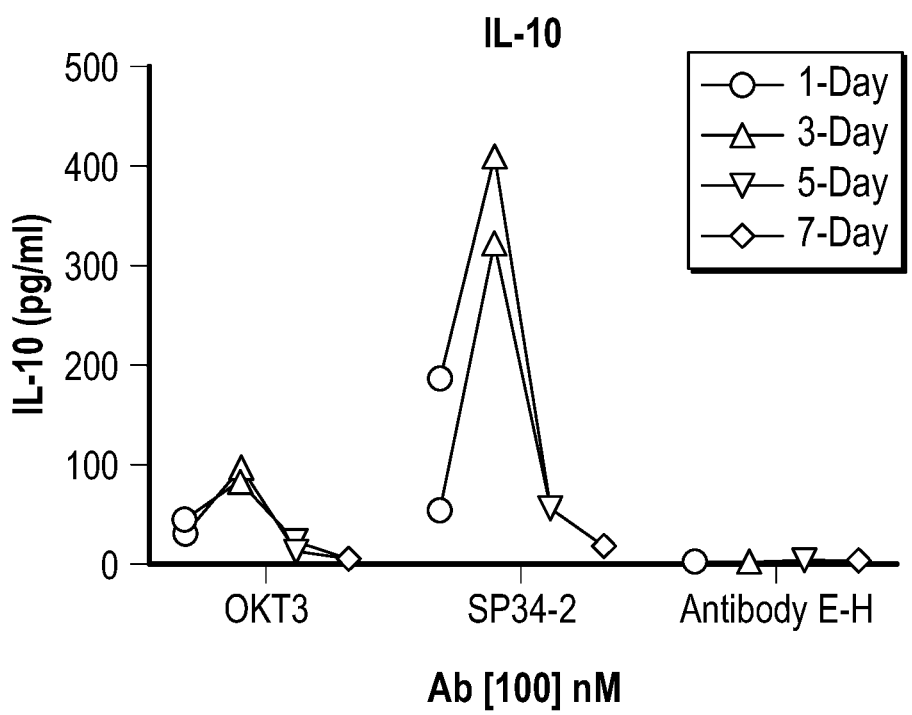

As shown in FIG. 21A, when plate-bound anti-TCR Vβ5 antibody (Antibody E) or anti-CD3e antibodies (OKT3 and SP34-2) were used to activate human PBMCs, the T cell cytokine IFNg was induced. With respect to IL-2 production, PBMCs activated with anti-TCR Vβ5 antibody (Antibody E) resulted in increased IL-2 production with delayed kinetics (FIG. 21B) as compared to PBMCs activated with anti-CD3e antibodies (OKT3 or SP34-2).

The production of cytokines IL-6, IL-1β, IL-10 and TNF-alpha which are associated with "cytokine storms" (and accordingly CRS) was also assessed under similar conditions. FIGS. 22A-22D show that that while PBMCs activated with anti-CD3e antibodies demonstrate production of IL-1β (FIG. 22A), IL-6 (FIG. 22B), TNF-alpha (FIG. 22C) and IL-10 (FIG. 22D), no or little induction of these cytokines was observed with PBMCs activated with anti-TCR Vβ5 antibody (Antibody E).

The data provided in this Example show that antibodies directed against TCR Vβ can, e.g., preferentially activate a subset of T cells, and do not results in induction of cytokines associated with cytokine storms or CRS.

Example 9: Characteristics of a Dual-Targeting Antibody Molecule Against BCMA and TCRβV This Example describes characterization of a dual targeting antibody (e.g., a bispecific molecule) comprising an anti-TCRβV binding moiety and a BCMA binding moiety (Molecule H) which can bind and activate a subset of T cells, but with, e.g., no or markedly reduced, CRS.

Human PBMCs were isolated from whole blood followed by solid-phase (plate-coated) stimulation with an anti-TCRβV x BCMA bispecific molecule (Molecule H) or anti-CD3e antibodies (OKT3), each at 100 nM. Supernatant was collected on Days 1, 2, 3, or 5 followed by multiplex cytokine analysis for IFNg, IL-2, IL-6, IL-1beta, IL-10 or TNFalpha. The data was quantified using MSD (Meso Scale Discovery) platform, following the manufacturer's protocol.

Figure 23A:
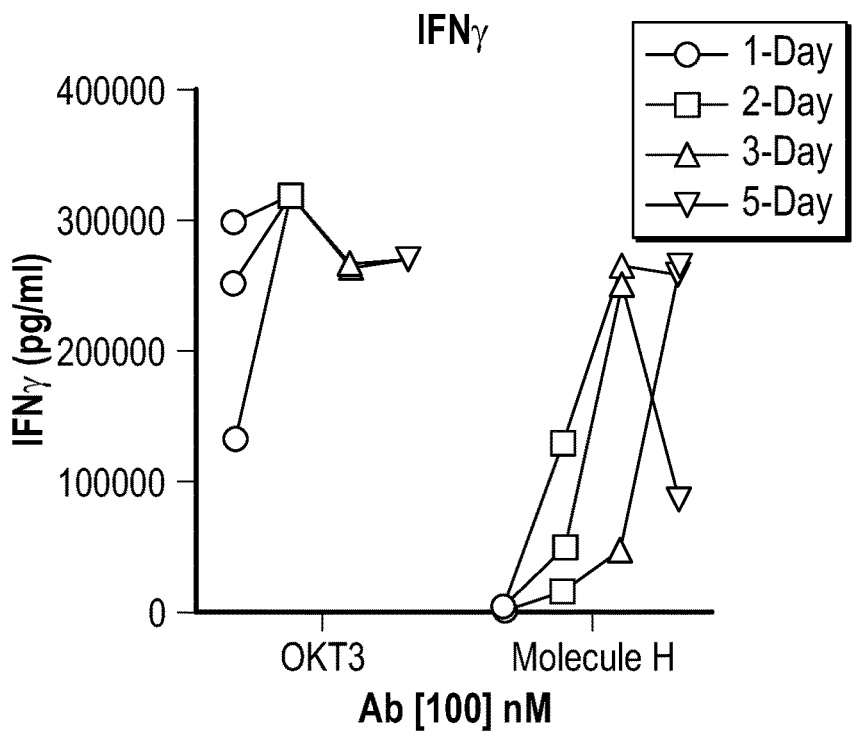
FIGS. 23A-23E demonstrate cytokine production from human PBMCs activated by a dual targeting (bispecific molecule) comprising an anti-TCRβV binding moiety and a BCMA binding moiety.
Figure 23B:
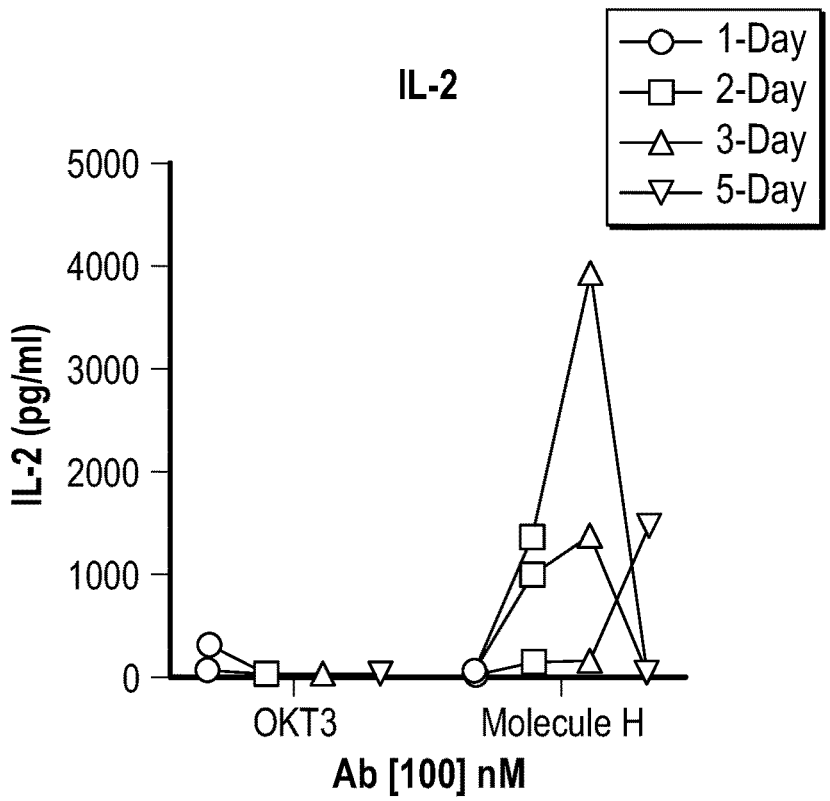

As shown in FIG. 23A, when plate-bound anti-TCRβV x BCMA bispecific molecule (Molecule H) or anti-CD3e antibodies (OKT3) were used to activate human PBMCs, the T cell cytokine IFNg was induced. With respect to IL-2 production, PBMCs activated with anti-TCRβV x BCMA bispecific molecule (Molecule H) resulted in increased IL-2 production (FIG. 23B) as compared to PBMCs activated with anti-CD3e antibodies (OKT3).

Figure 23C:
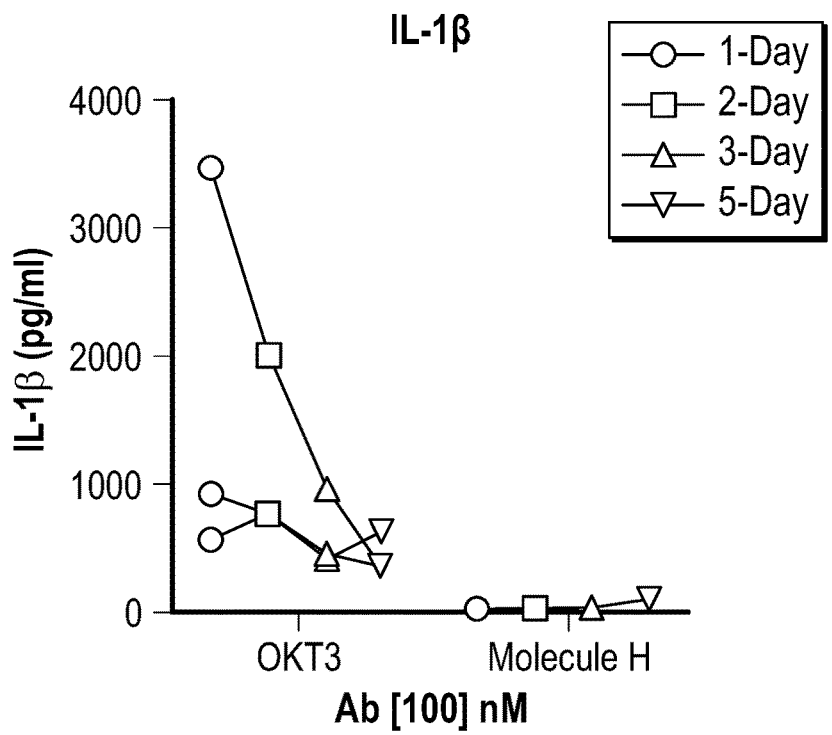
Figure 23D:
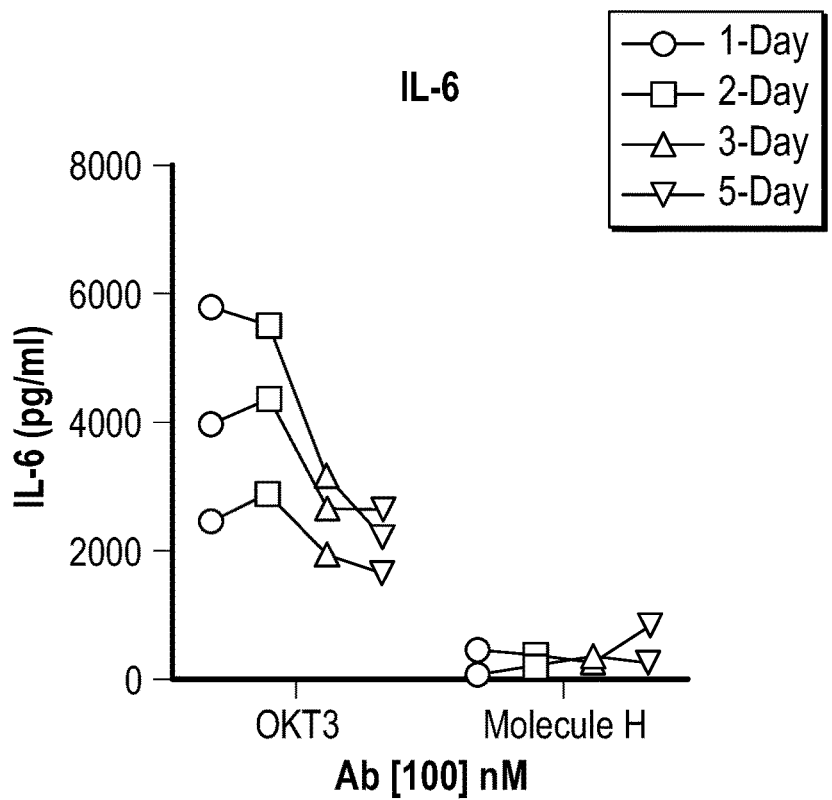
Figure 23E:
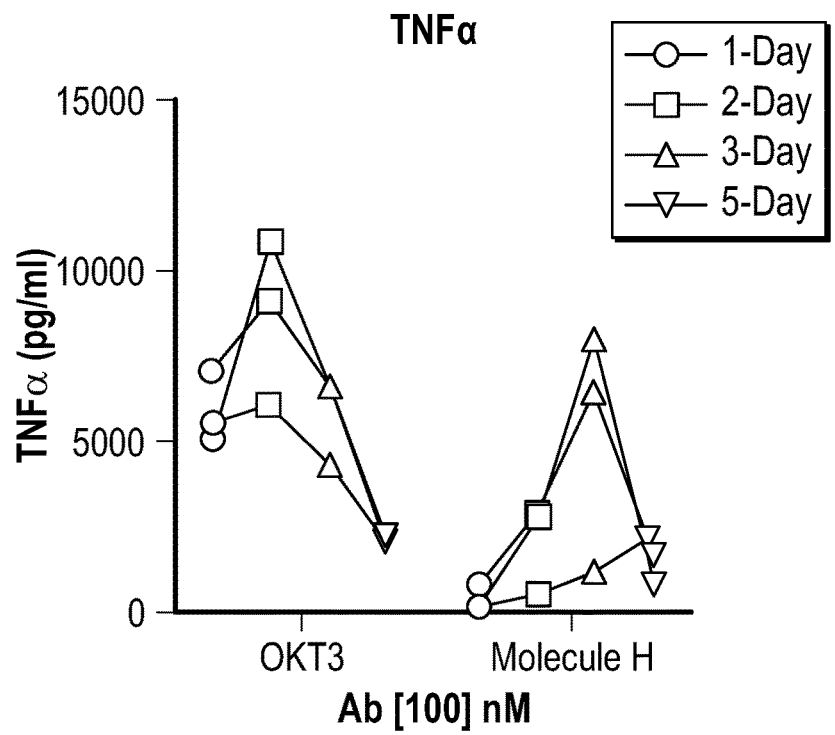
Figure 23F:
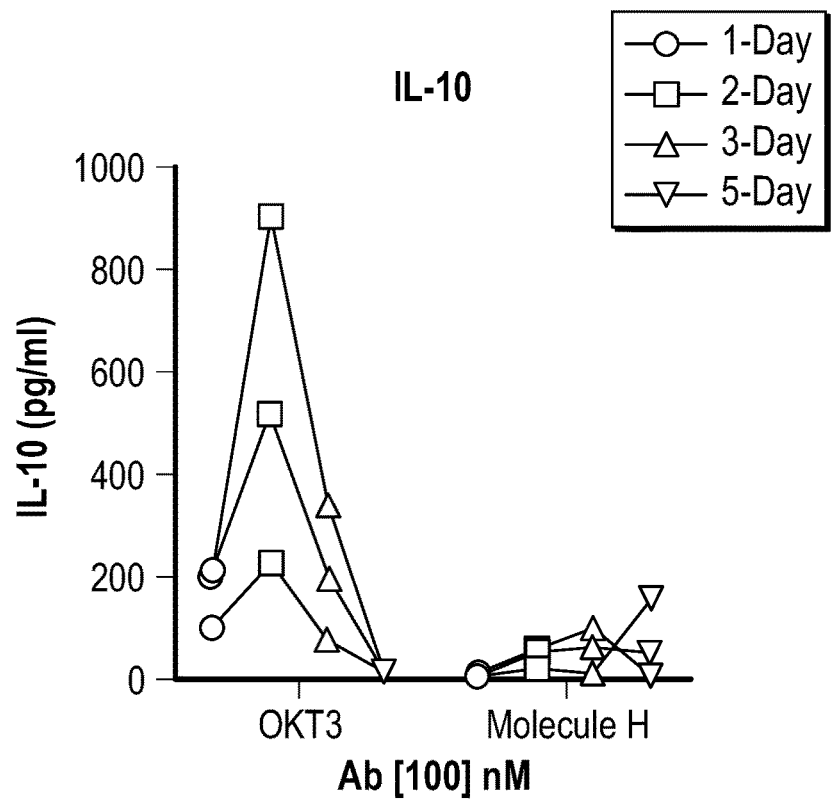

The production of cytokines IL-6, IL-1β, IL-10 and TNF-alpha which are associated with "cytokine storms" (and accordingly CRS) was also assessed under similar conditions. FIGS. 23C-E show that that while PBMCs activated with anti-CD3e antibodies demonstrate production of IL-1β (FIG. 23C), IL-6 (FIG. 23D), TNF-alpha (FIG. 23D) and IL-10 (FIG. 23E), no or little induction of these cytokines was observed with PBMCs activated with anti-TCRβV x BCMA bispecific molecule (Molecule H).

The data provided in this Example show that antibodies directed against TCR Vβ can, e.g., preferentially activate a subset of T cells, and do not result in induction of cytokines associated with cytokine storm or CRS.

Example 10: Cytokine and Chemokine Profile of Anti-TCRVb Antibodies

This Examples describes cytokines and chemokines secreted by PBMCs following activation by anti-TCR Vβ antibodies.

Human PBMCs were isolated from whole blood followed by solid-phase (plate-coated) stimulation with an anti-TCRβV antibodies (A-H.1, B-H.1), or a bispecific molecule comprising an anti-TCRVb antibody (Molecule H), an isotype control (BGM0122) or an anti-CD3e antibody (SP34), each at 100 nM. Supernatant was collected on Days 1, 2, 3, 4, 5, 6, 7 and 8 followed by multiplex analysis for the indicated cytokines or chemokines. The data was quantified using MSD (Meso Scale Discovery) platform, following the manufacturer's protocol. BGM0122 comprises the amino acid sequence of METDTLLLWVLLLWVPGSTGDKTHTCPPCPA-PELLGGPSVFLFPPKPKDTLMISRTPEVT CVVVDVSHEDPEVKFNWYVDGVEVHNAKTKPRE-EQYNSTYRVVSVLTVLHQDWLNG KEYKCKVSNKA-LPAPIEKTISKAKGQPREPQVYTLPPSREEMT-KNQVSLTCLVKGFYPSD IAVEWESNGQPENNYKTTPPVLDSDGSFFLYSK-LTVDKSRWQQGNVFSCSVMHEALHN HYTQKSLSL-SPGKGGGGSGGGGSGLNDIFEAQKIEWHE (SEQ ID NO: 3283).

FIGS. 25A-25J, FIGS. 26A-26H, and FIGS. 27A-27L show the levels of cytokine and chemokine from PBMCs activated with the indicated antibodies.

Figure 25A:
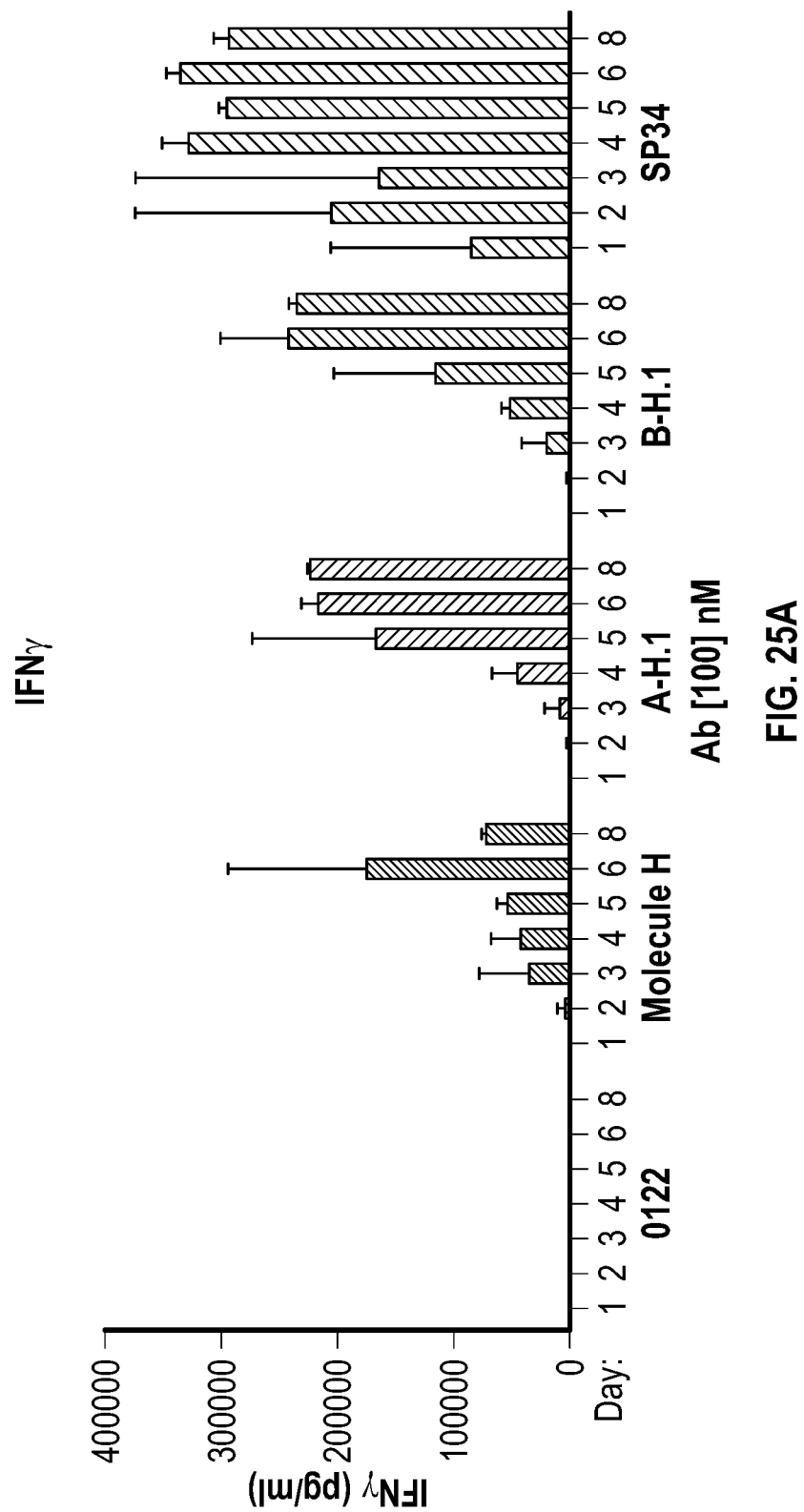
Figure 25B:
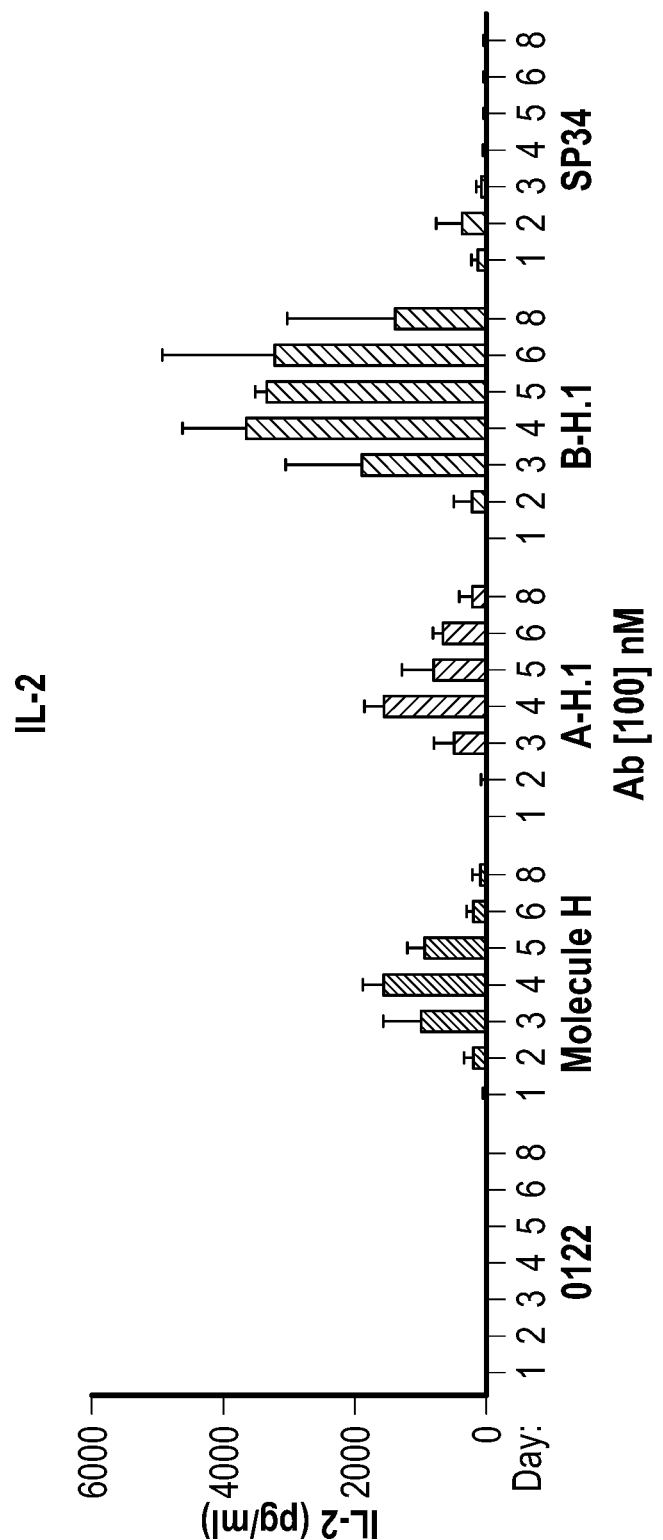
Figure 25C:
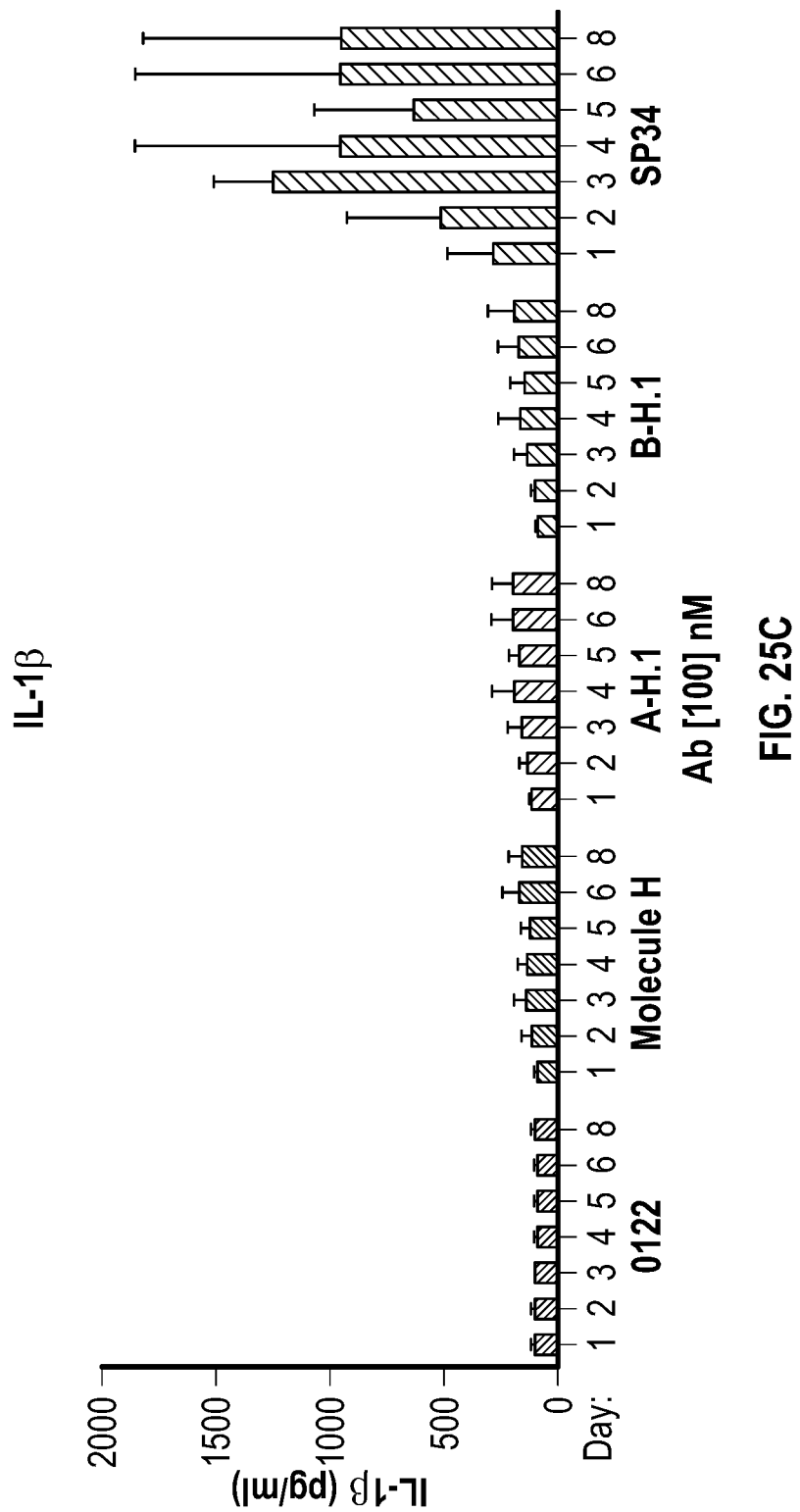
Figure 25F:
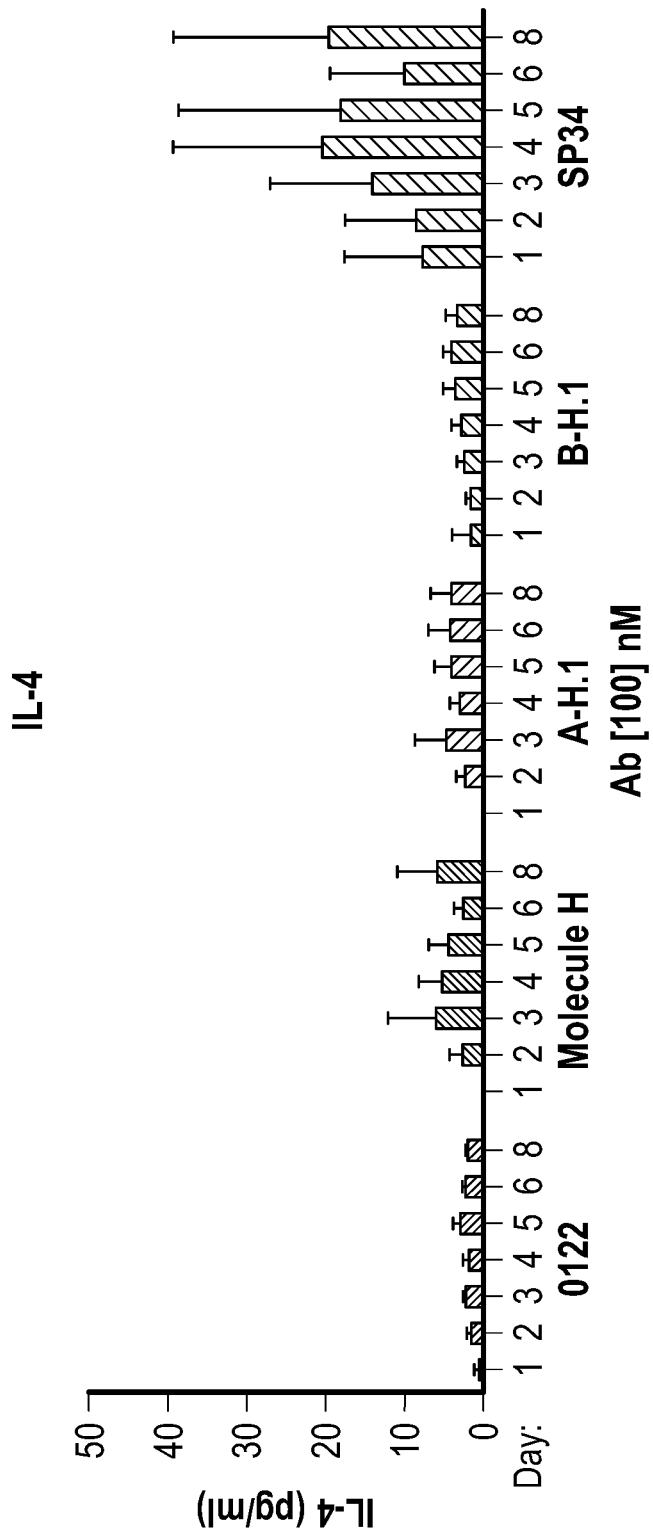
Figure 25G:
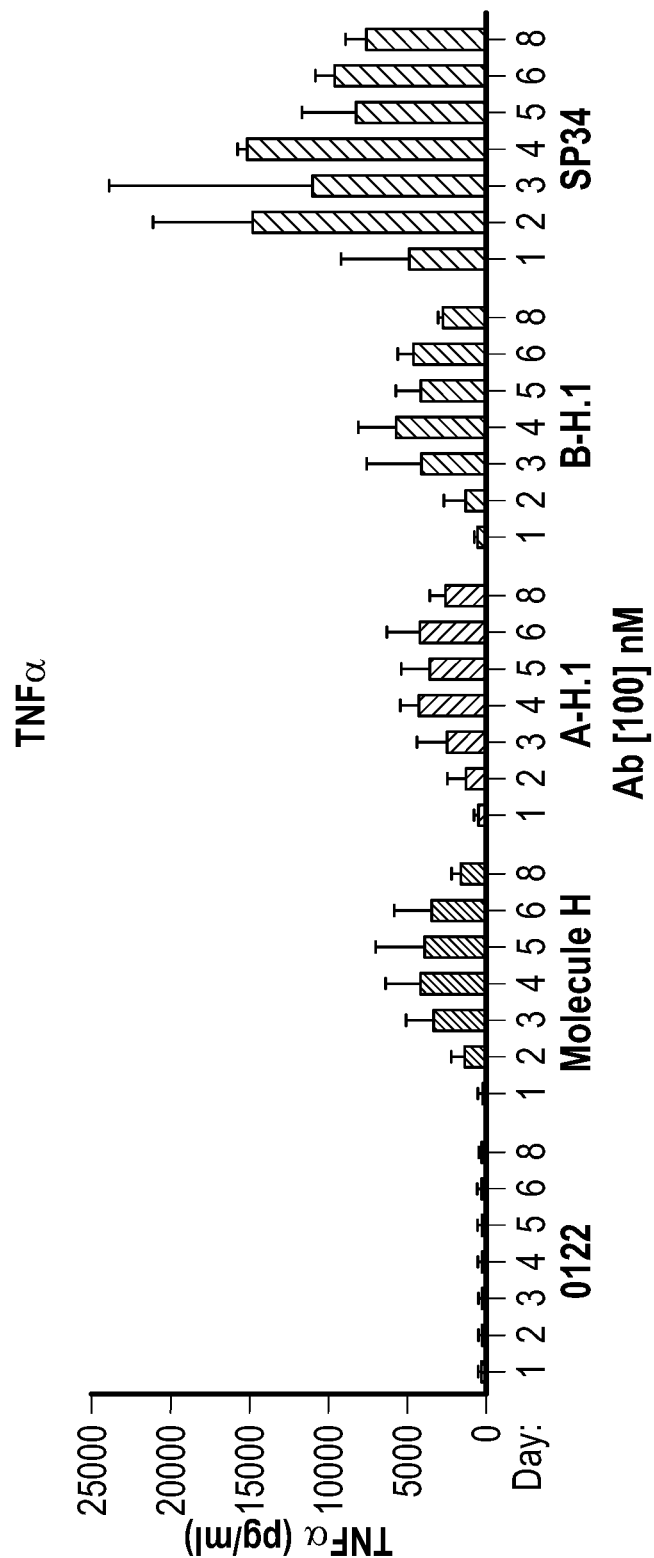
Figure 25H:
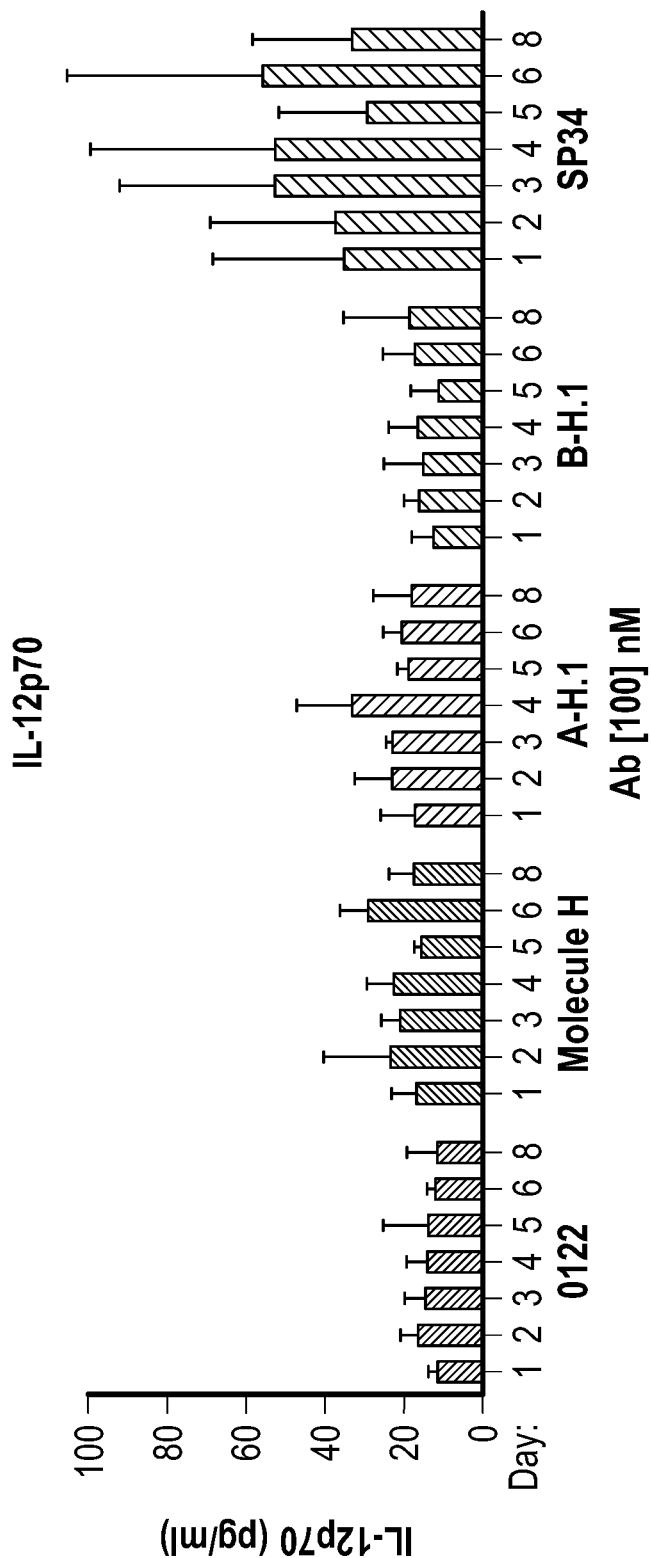
Figure 25I:
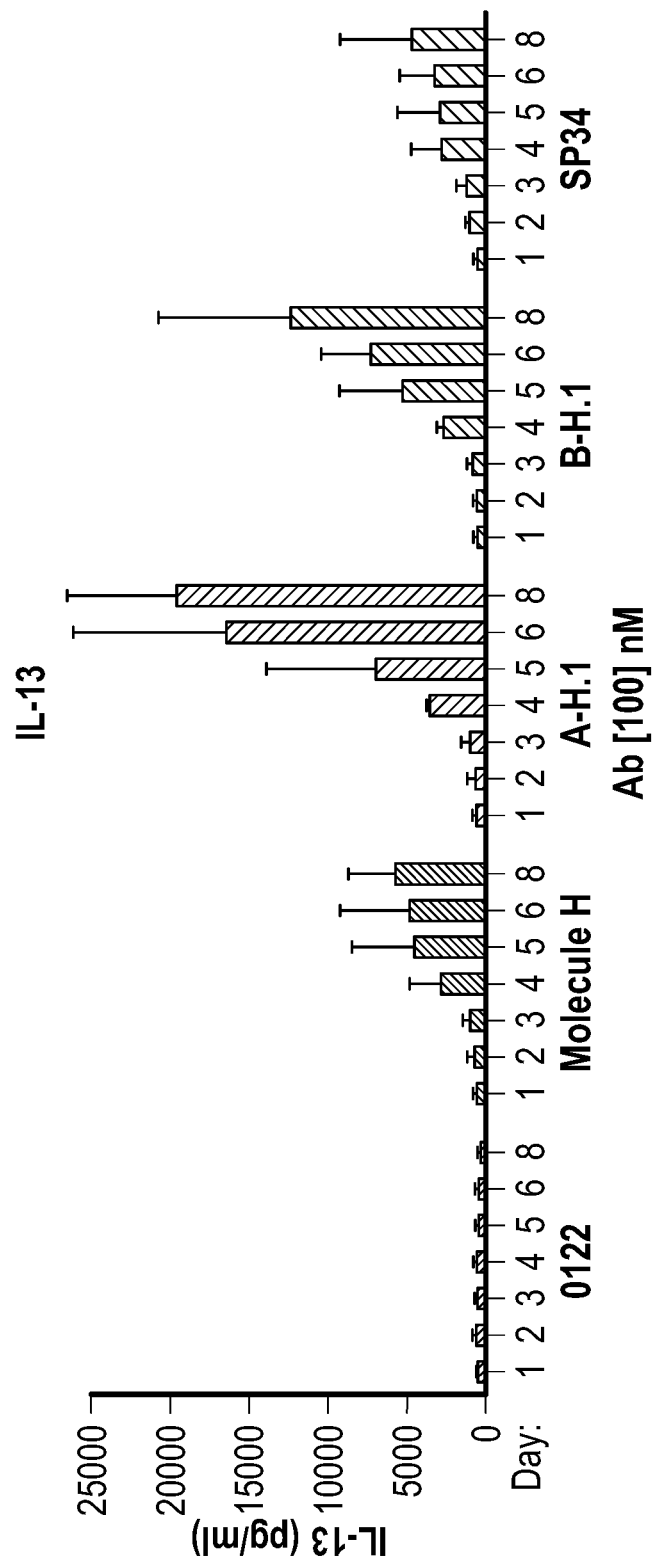
Figure 25J:
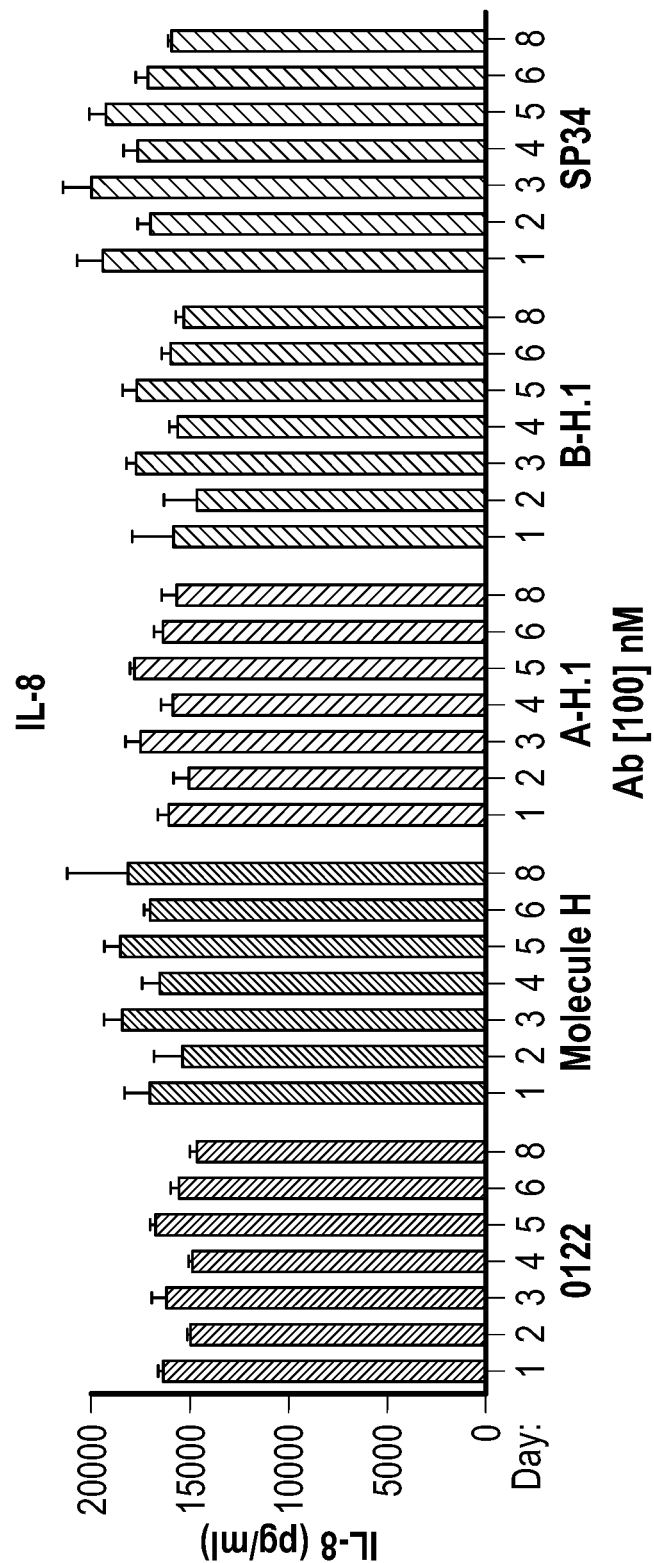
Figure 26A:
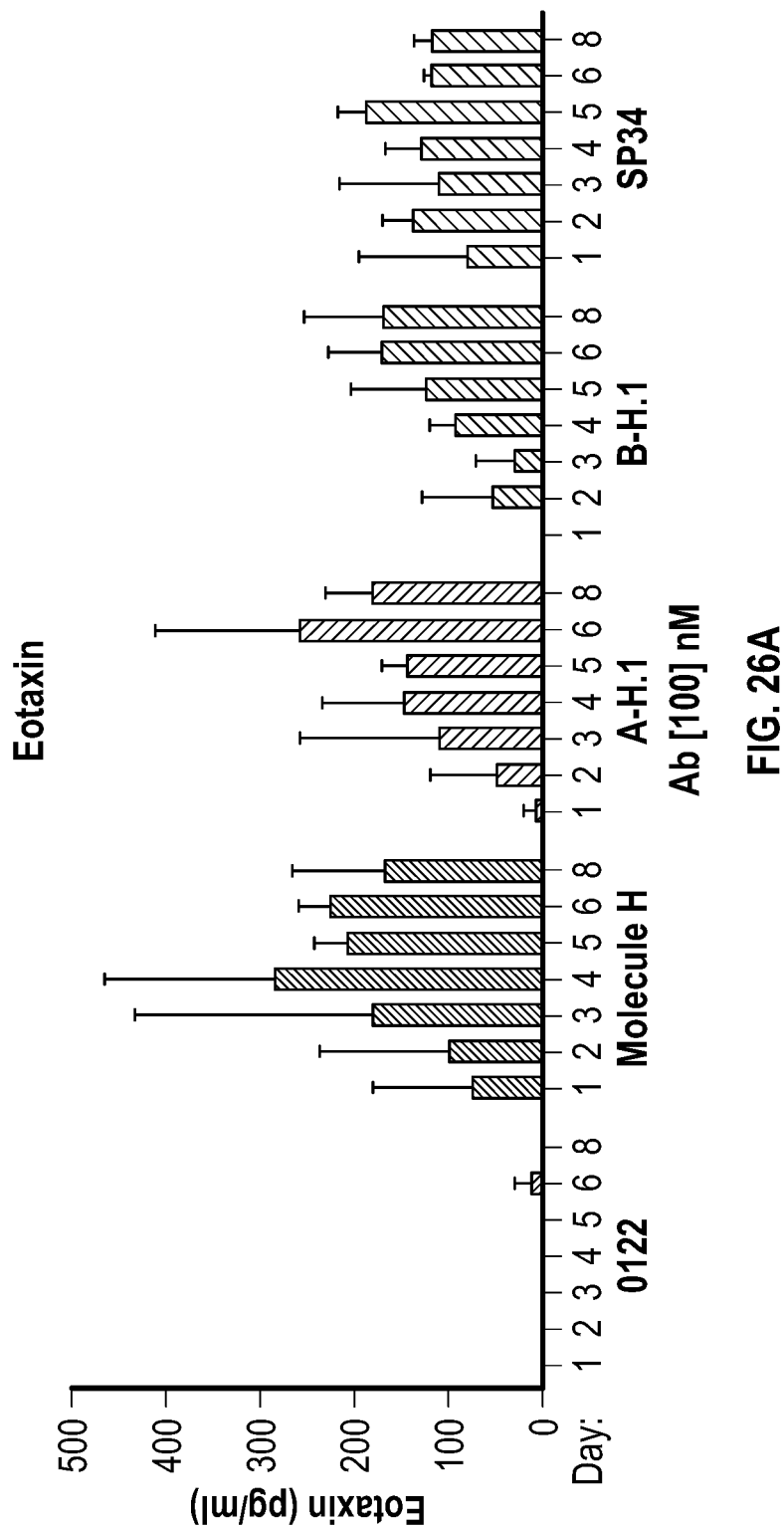
Figure 26B:
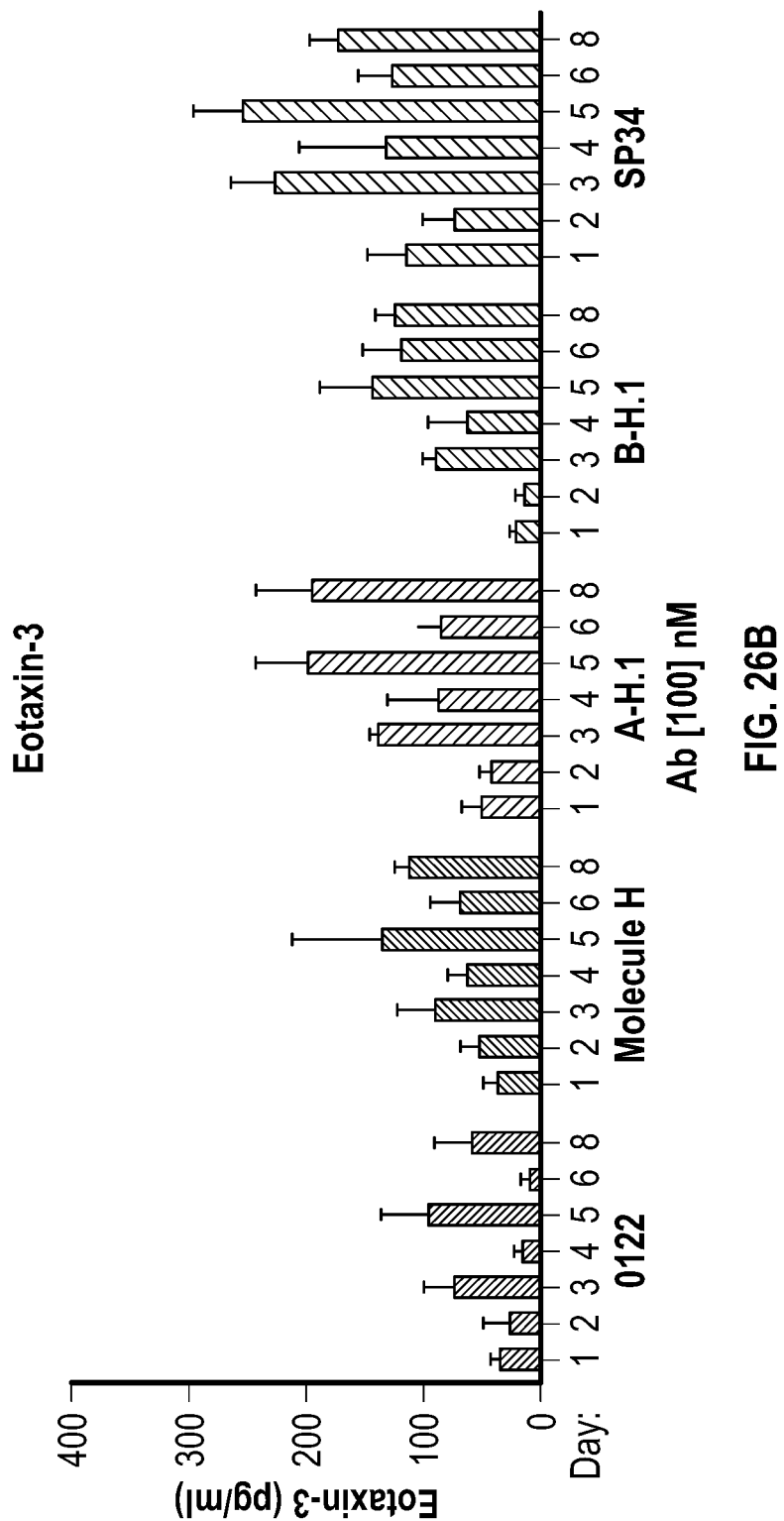
Figure 26C:
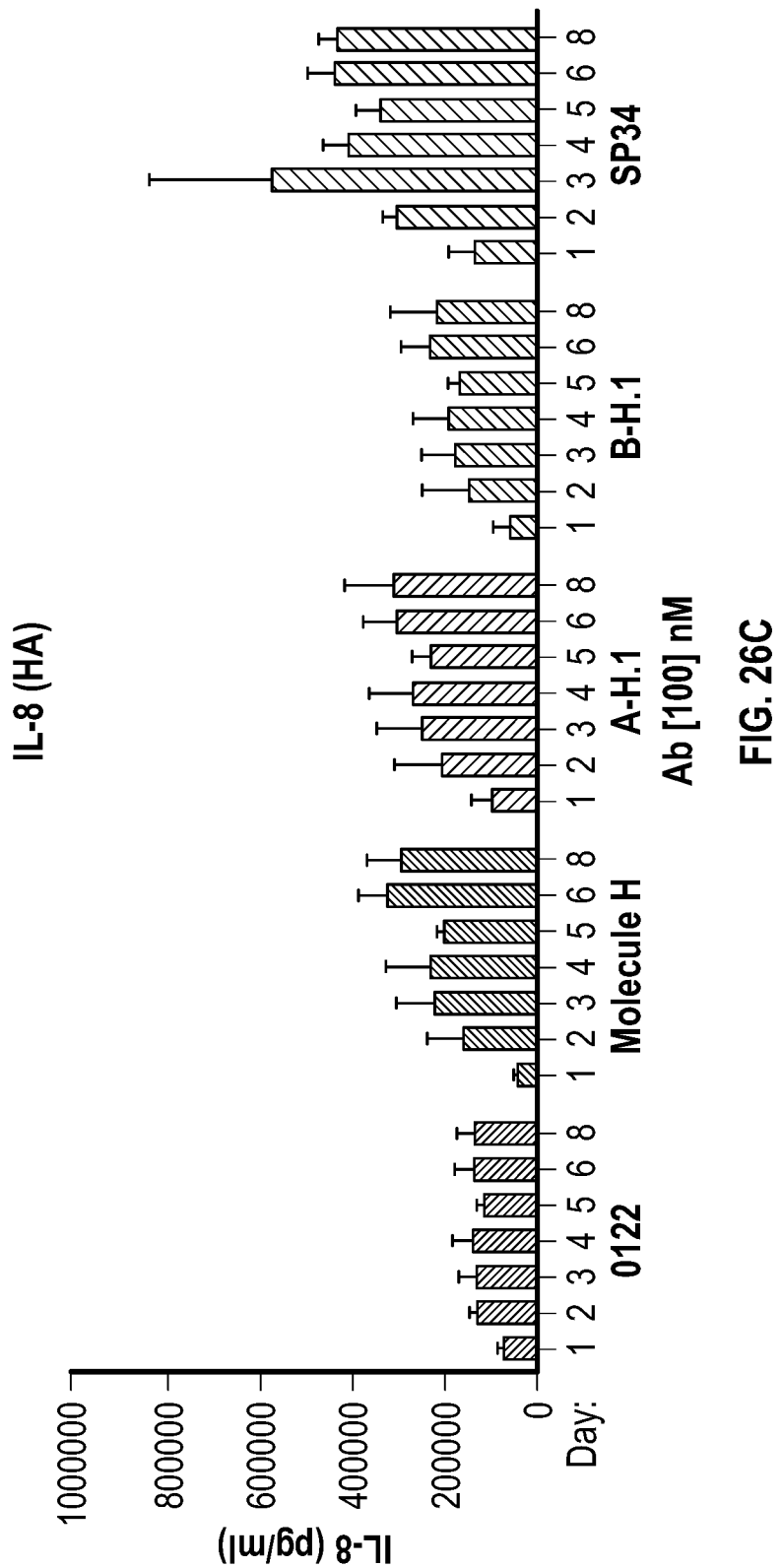
Figure 26E:
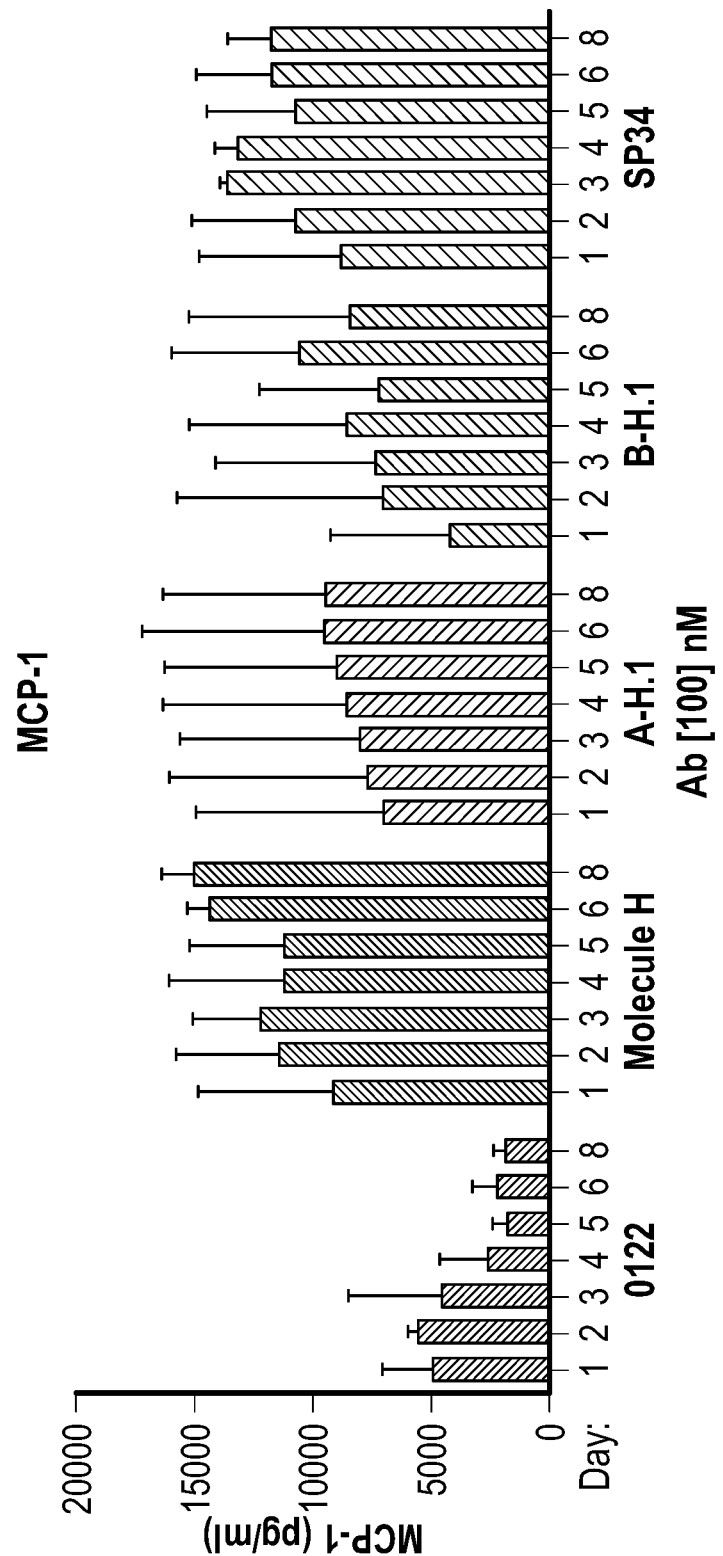
Figure 26F:
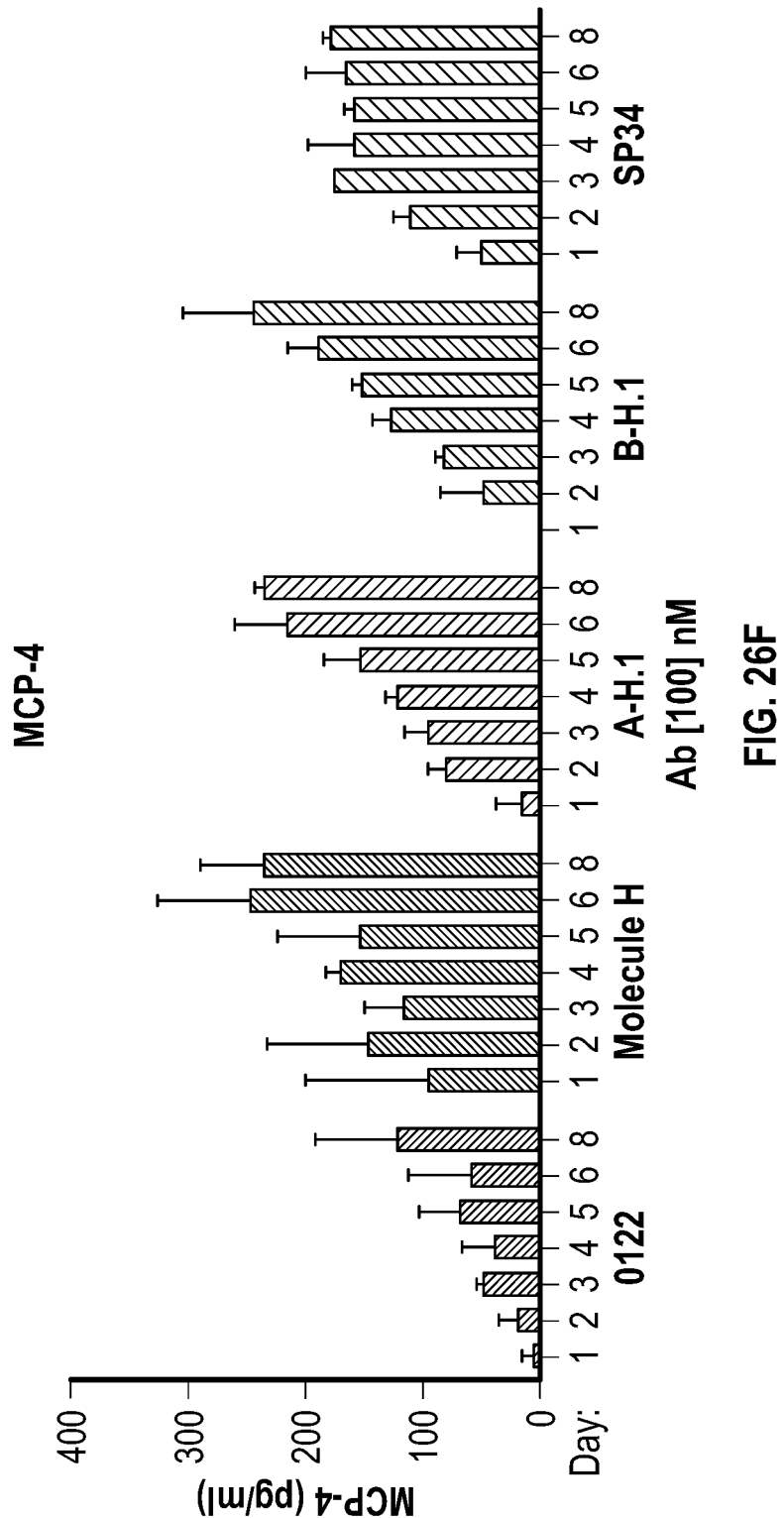
Figure 26G:
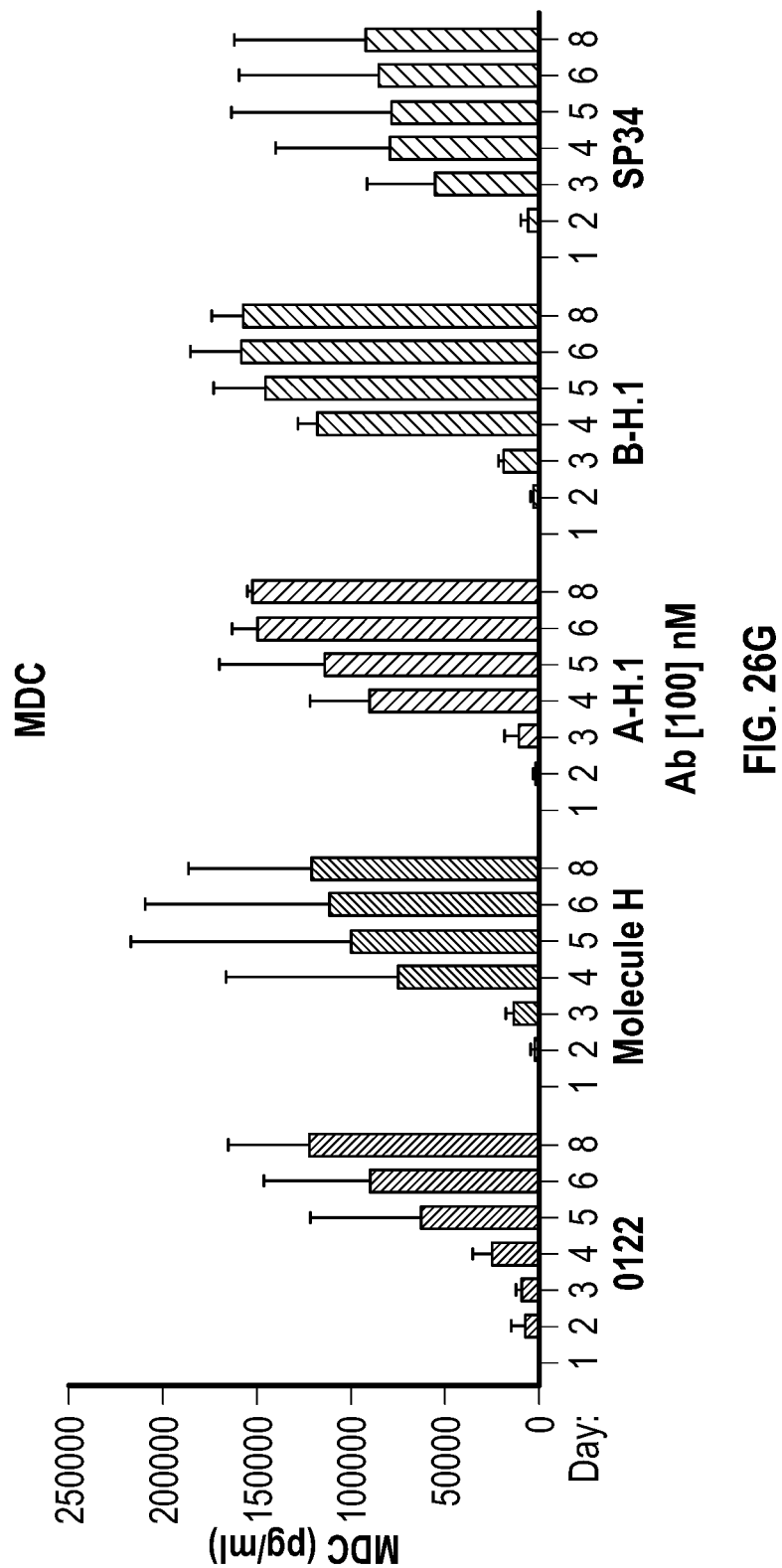
Figure 26H:
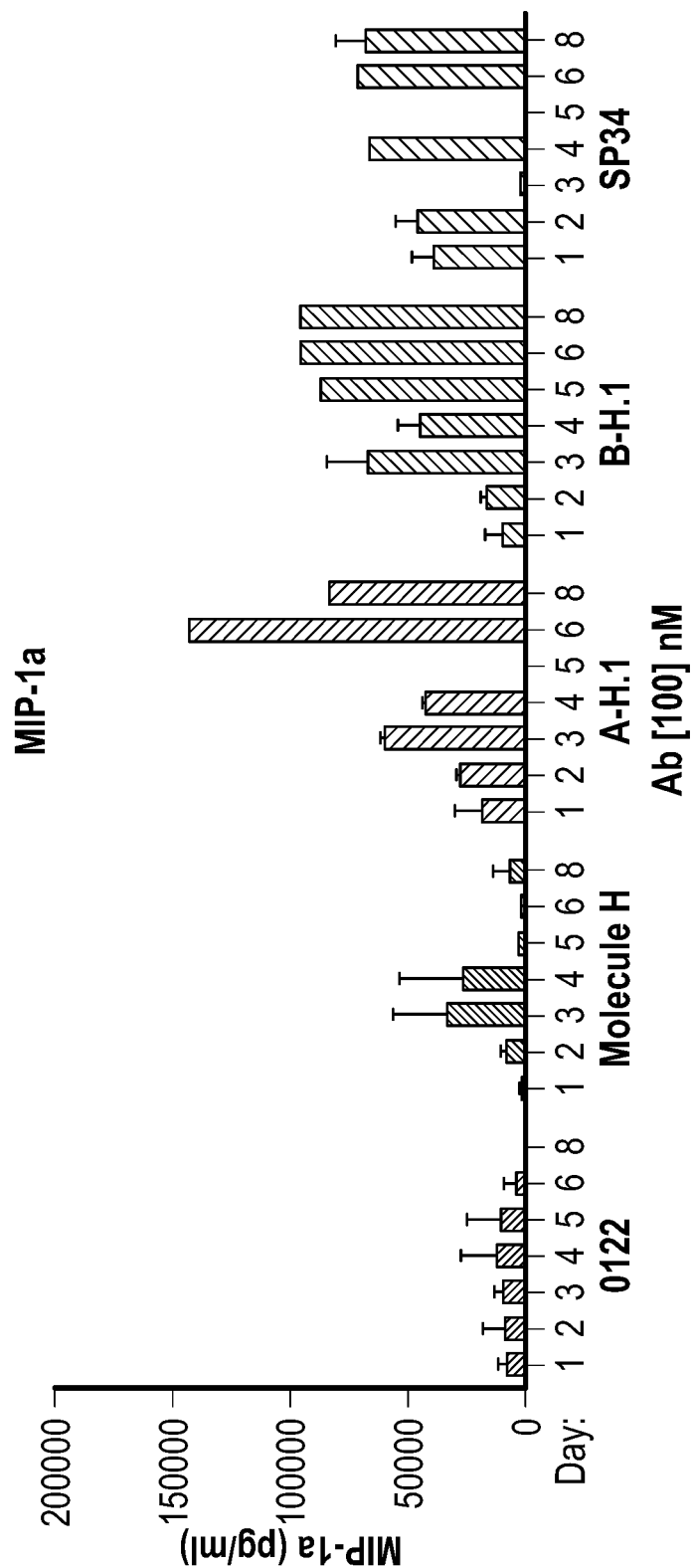

As shown in FIG. 25A, when plate-bound anti-TCR Vβ antibodies or anti-CD3e antibodies (OKT3) were used to activate human PBMCs, the T cell cytokine IFNg was induced.

With respect to IL-2 production, PBMCs activated with anti-TCR Vβ antibodies resulted in increased IL-2 production with delayed kinetics (FIG. 25B) as compared to PBMCs activated with anti-CD3e antibody (OKT3).

While IL-1beta (FIG. 25C), IL-6 (FIG. 25D), IL-10 (FIG. 25E), IL-4 (FIG. 25F), TNFalpha (FIG. 25G), IP-10 (FIG. 26C), IL-12-23p40 (FIG. 27D), IL-17A (FIG. 27G), and IL-1a (FIG. 27H), were induced by anti-CD3e antibody (OKT3), no or little induction of these cytokines or chemokines was observed with PBMCs activated with anti-TCRVb antibodies.

Figure 27A:
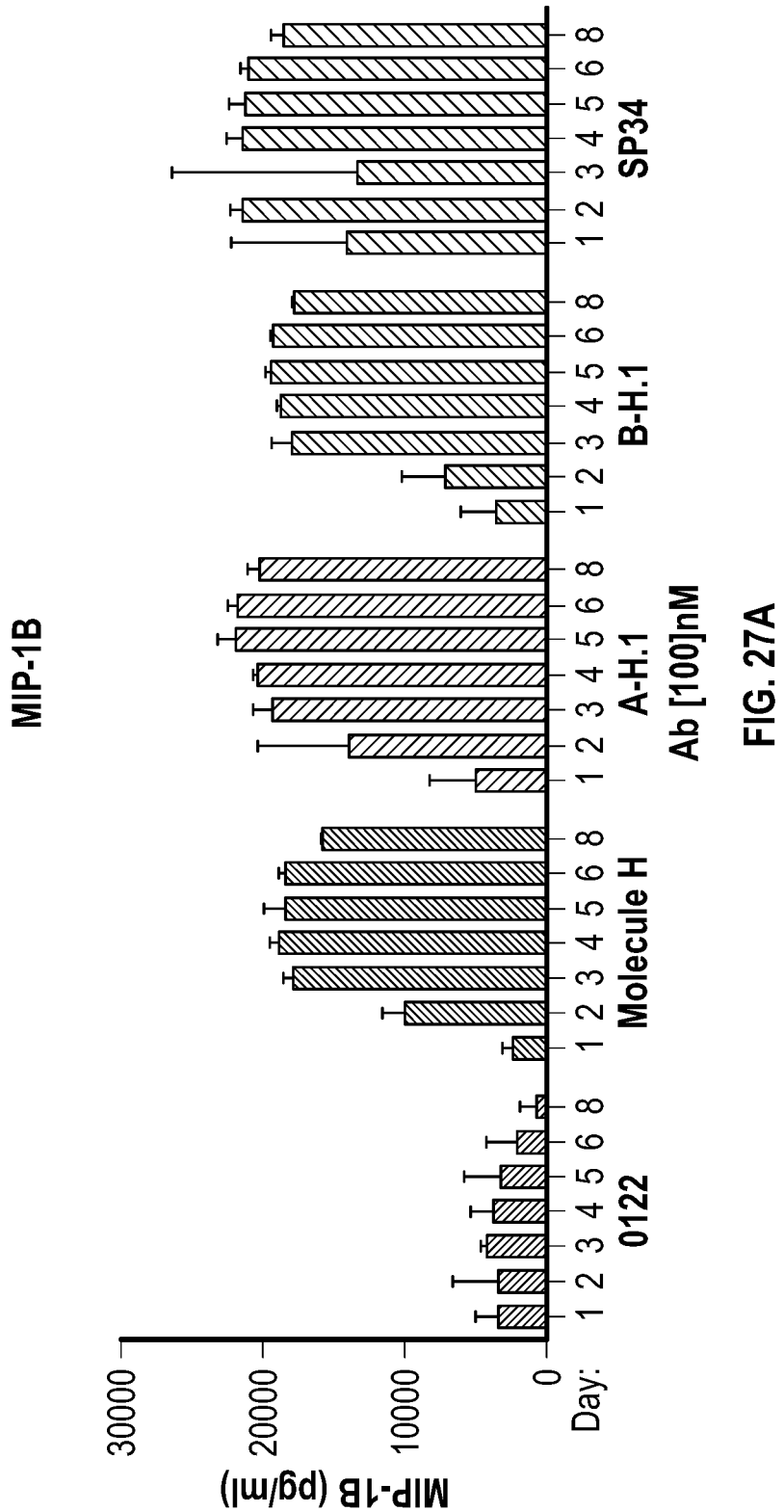
Figure 27C:
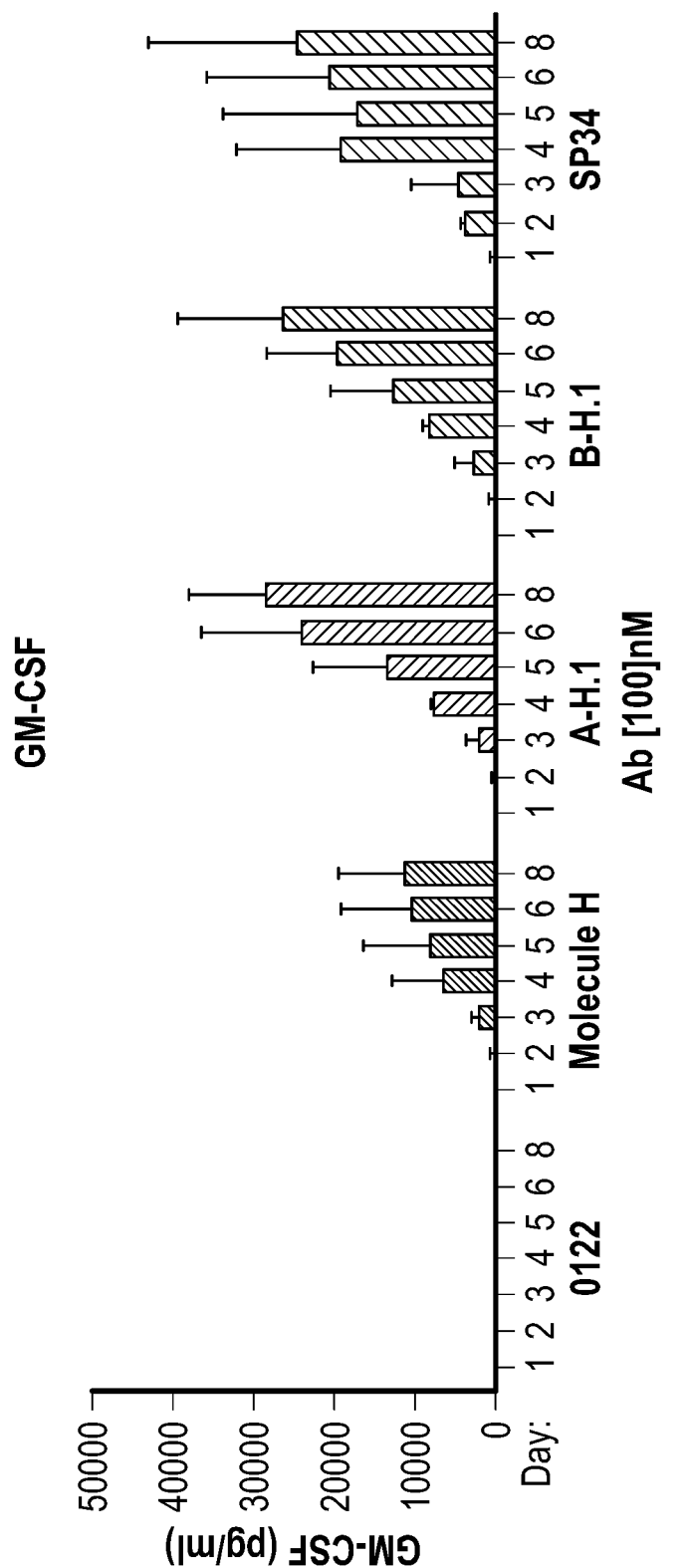
Figure 27D:
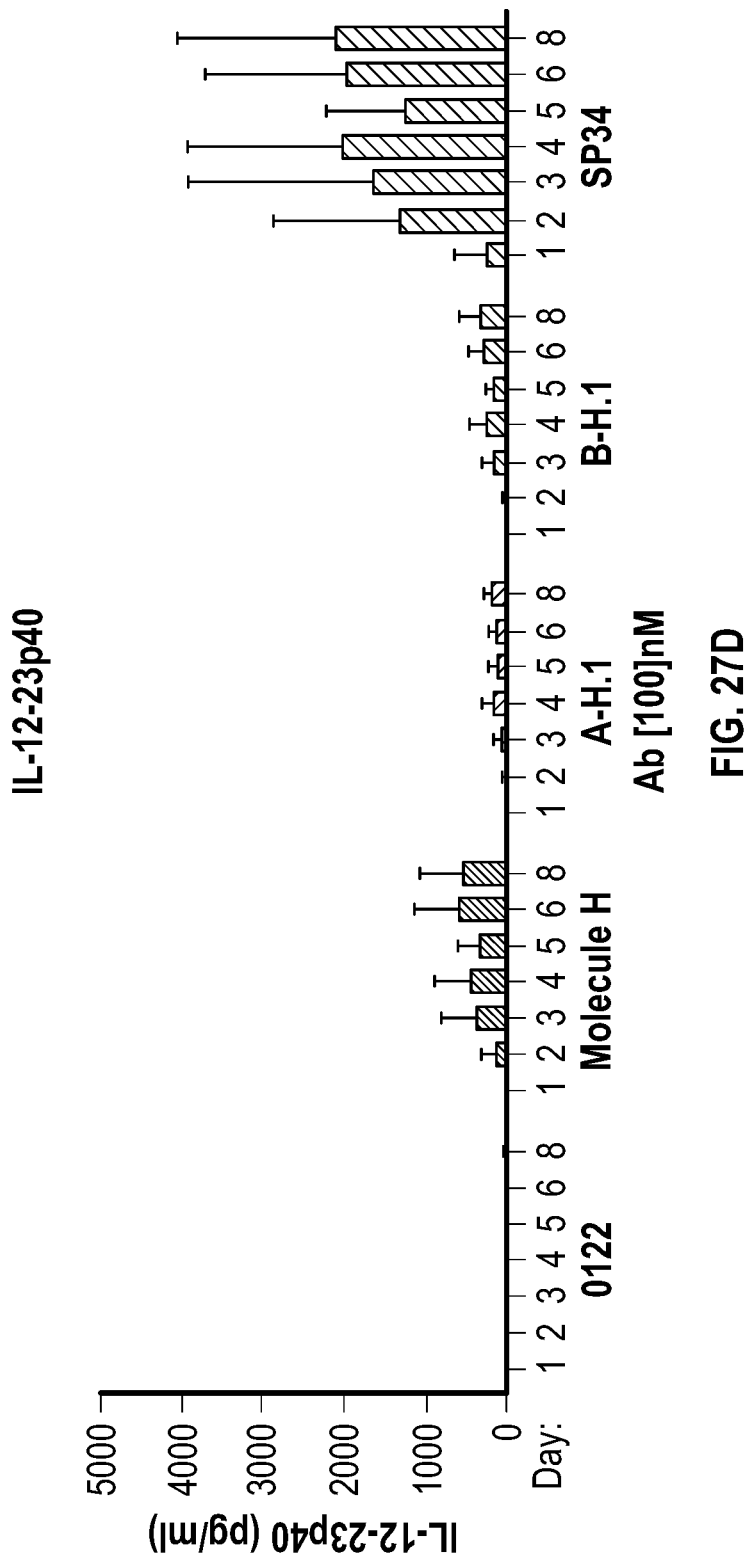
Figure 27E:
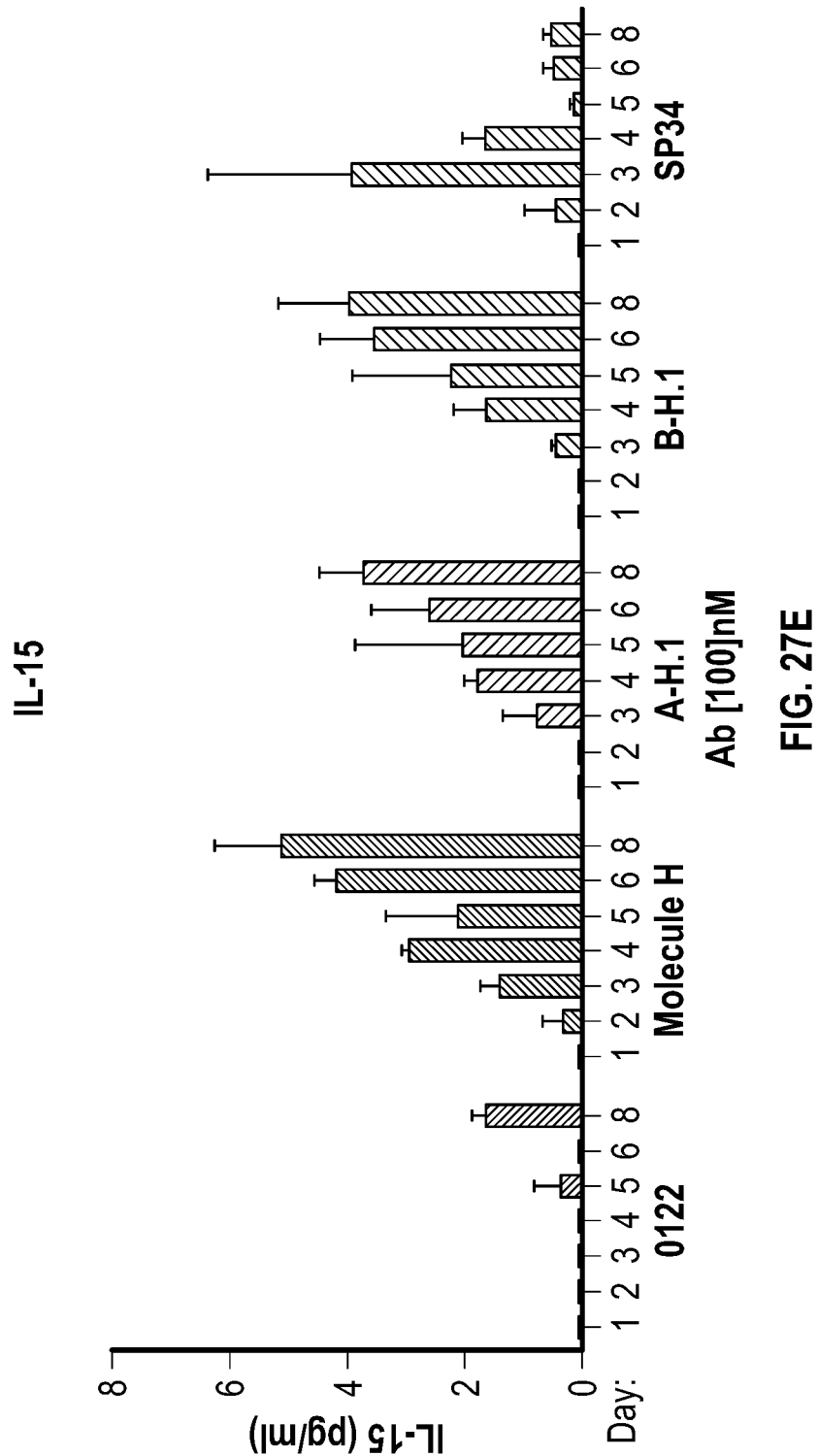
Figure 27F:
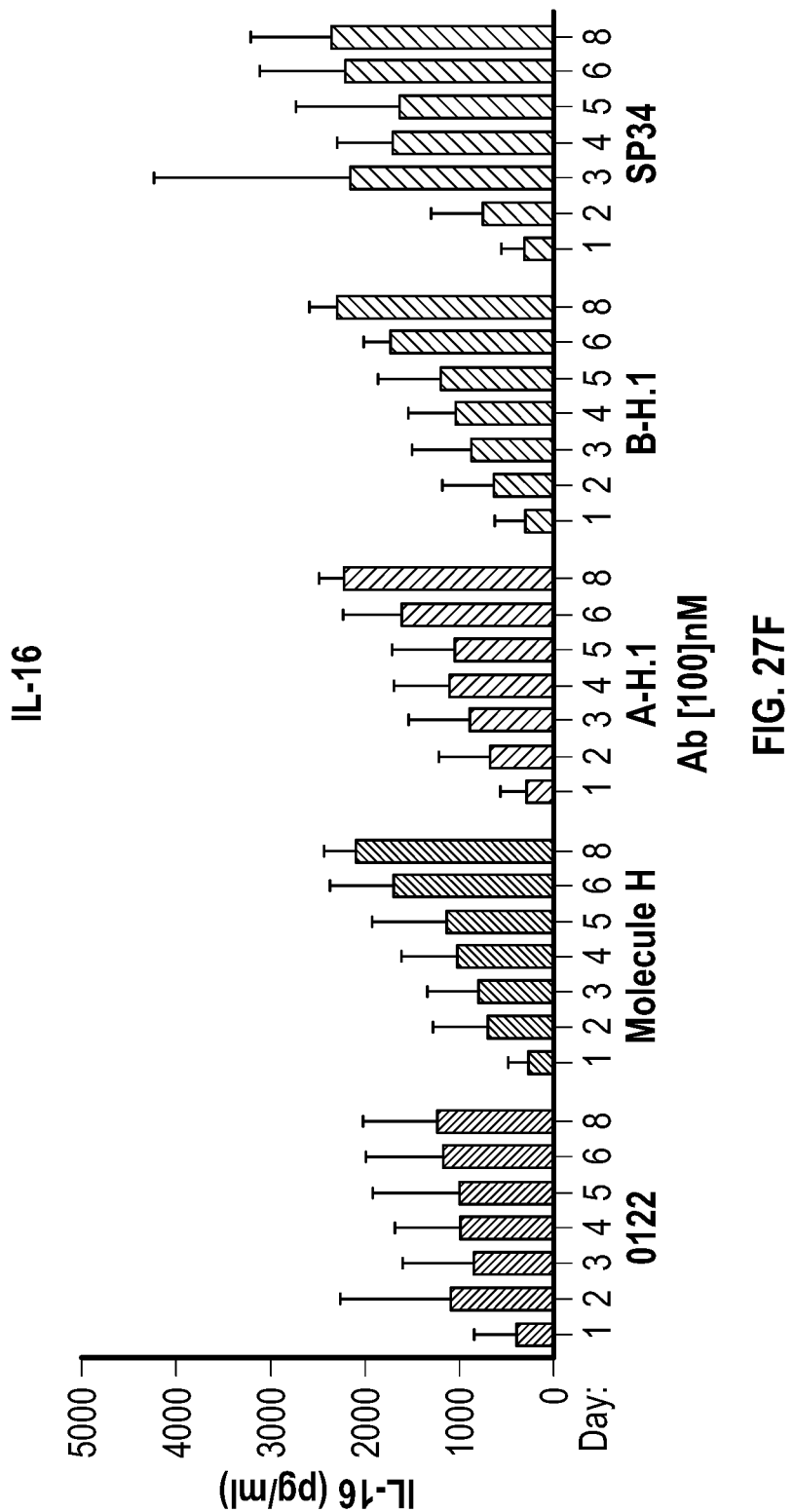
Figure 27G:
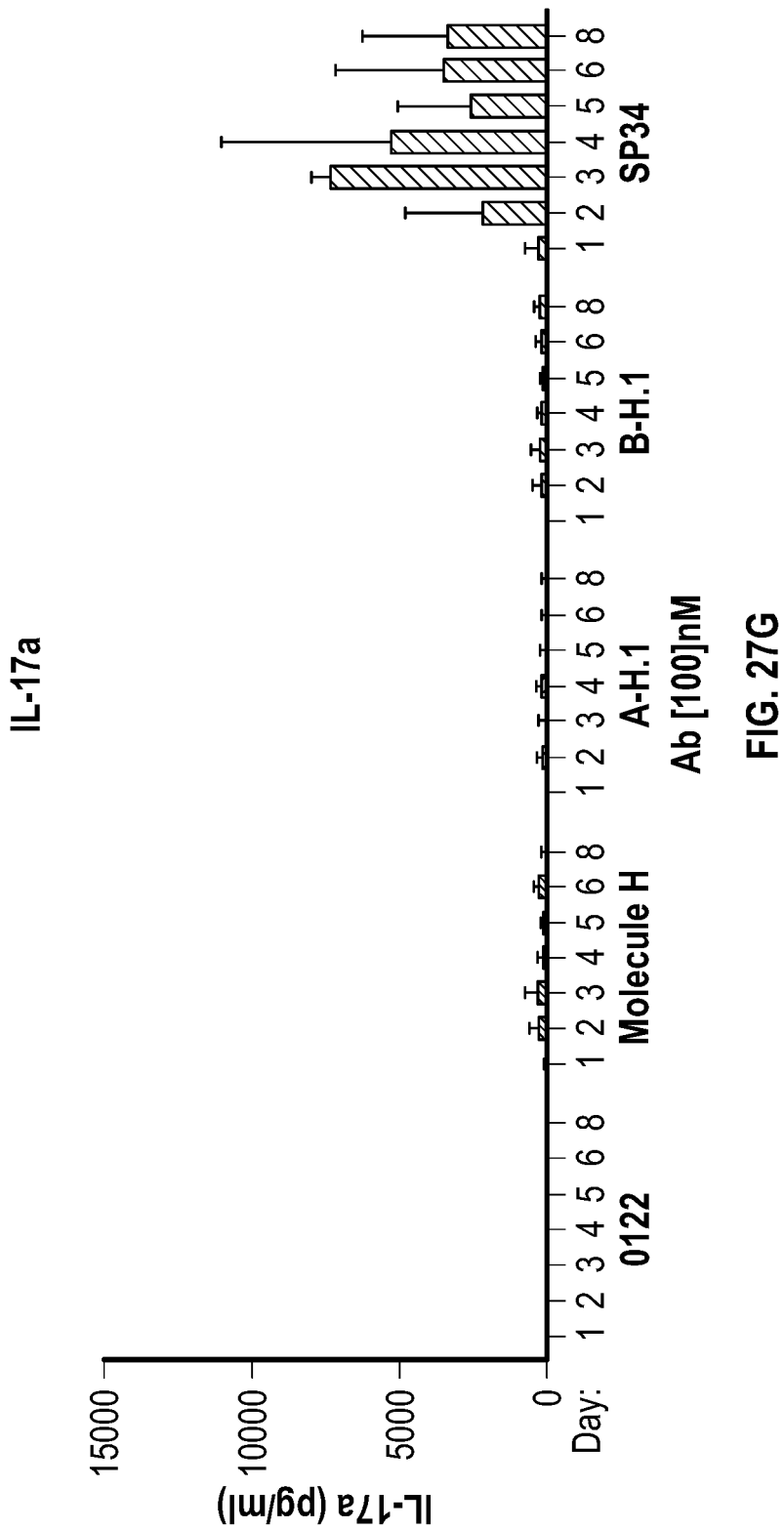
Figure 27H:
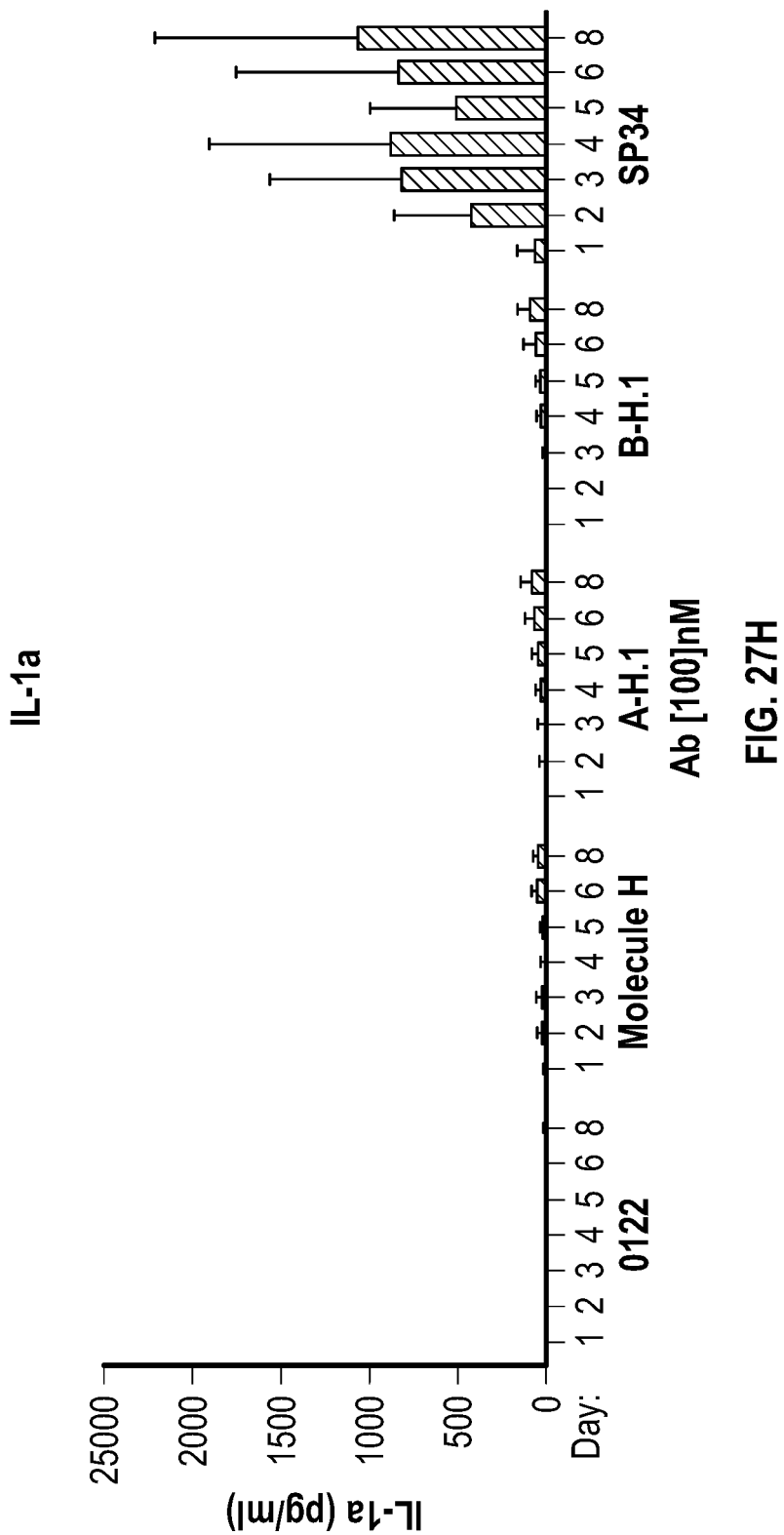
Figure 27I:
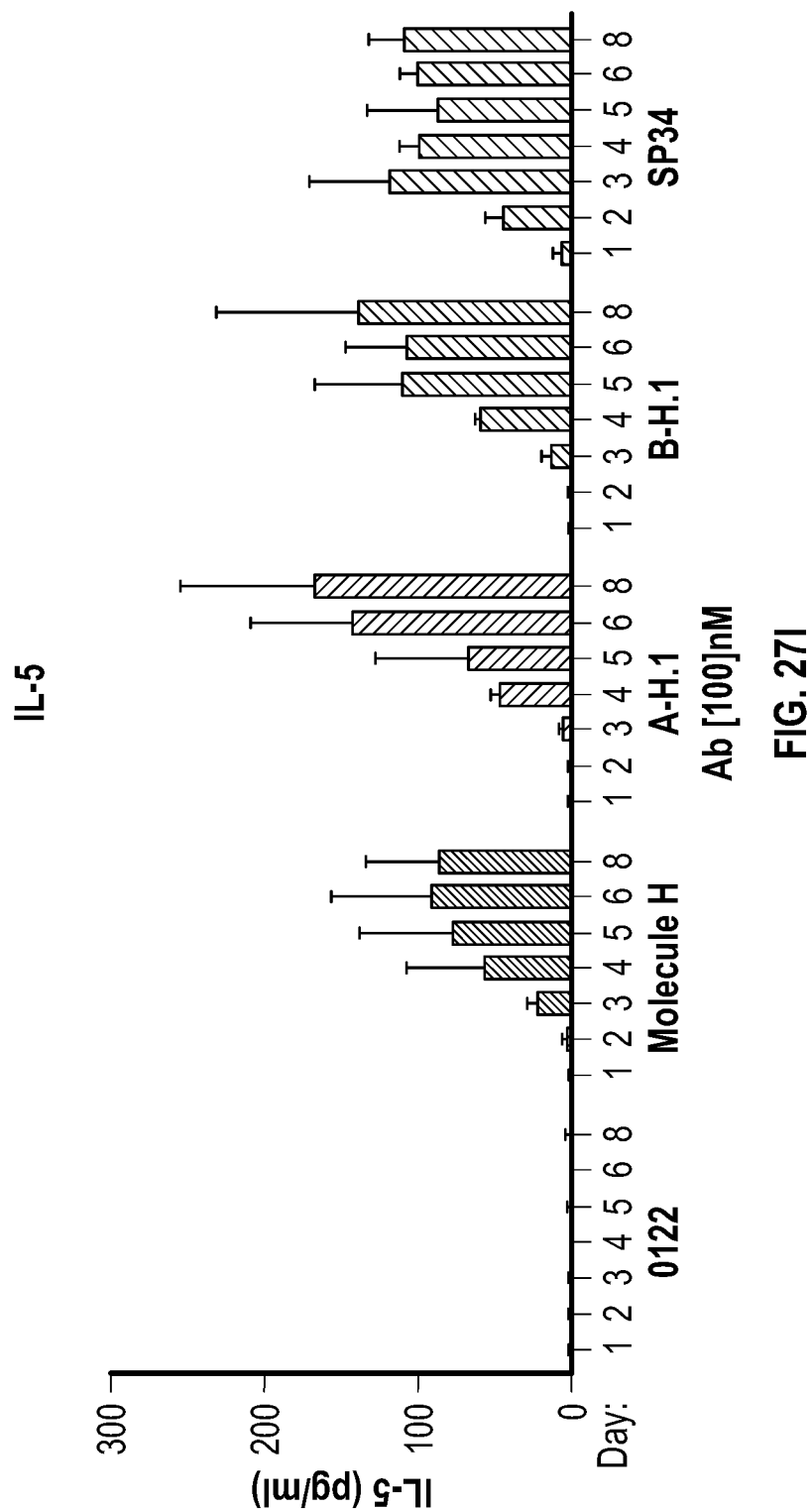
Figure 27J:
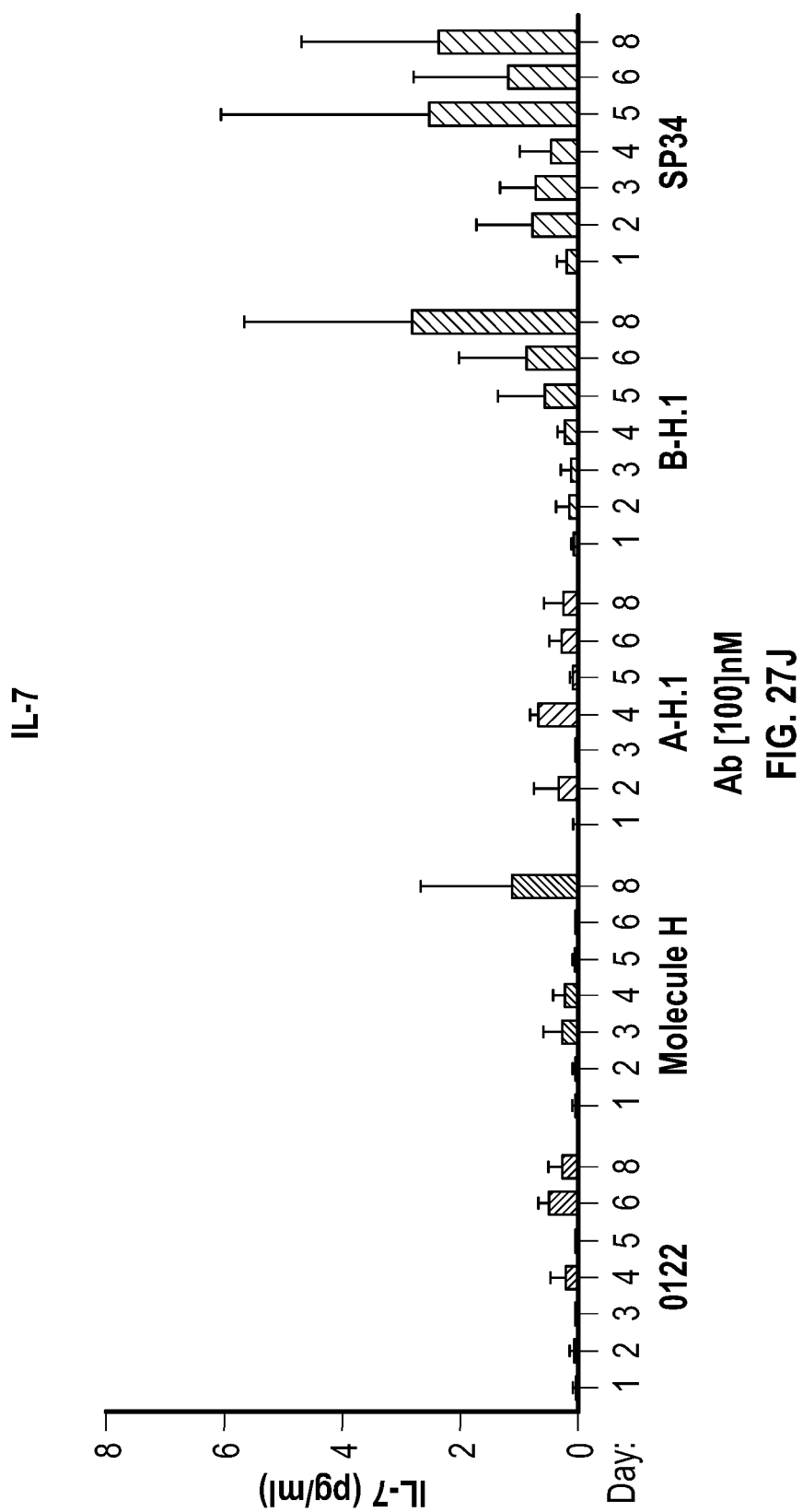
Figure 27K:
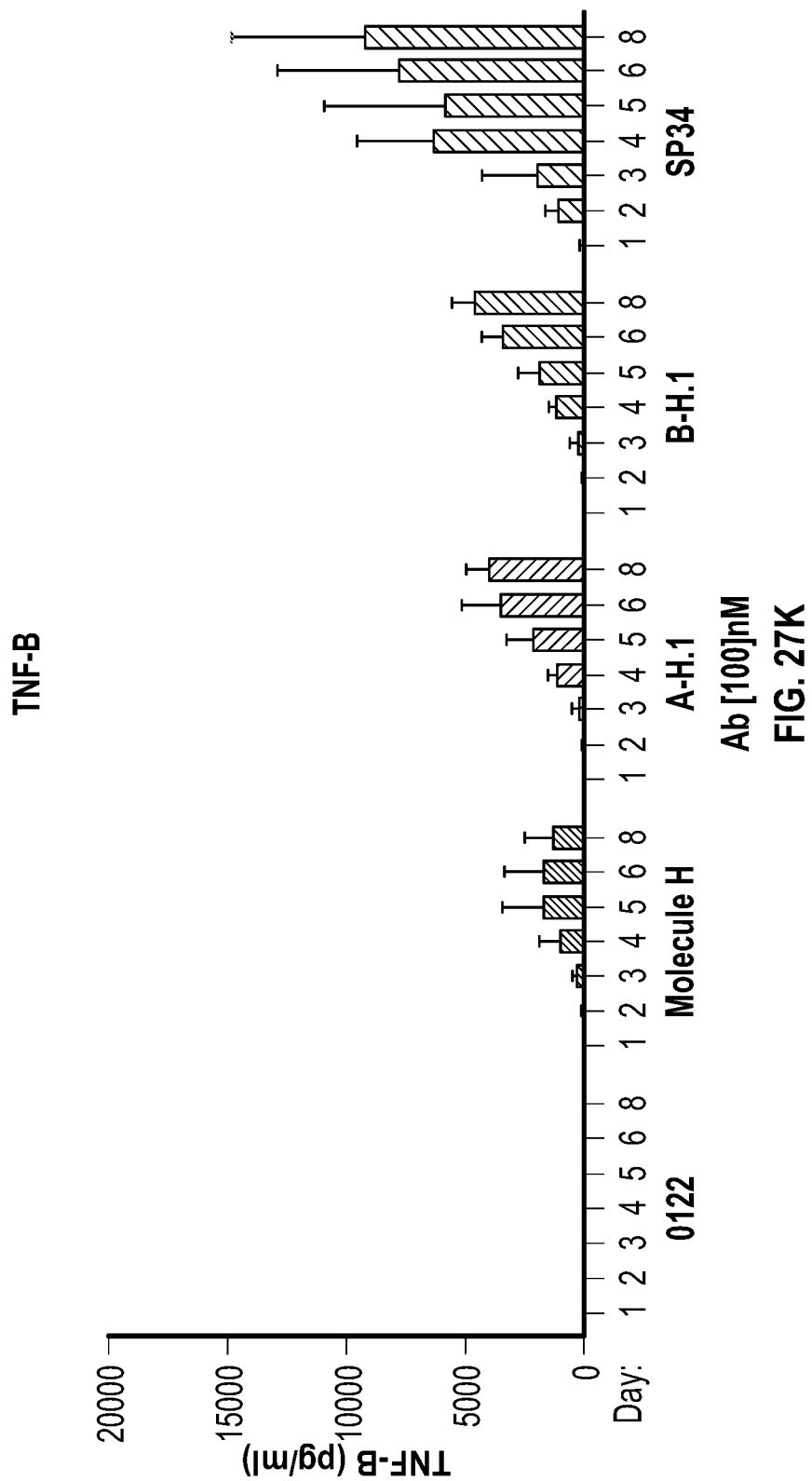

PBMCs activated with anti-TCR Vβ antibodies demonstrated induction of IL-13 (FIG. 25I), IL-8 (FIG. 25J), Eotaxin (FIG. 26A), Eotaxin 3 (FIG. 26B), IL-18 (HA) (FIG. 26C), MCP-1 (FIG. 26E), MCP-4 (FIG. 26F), MDC (FIG. 26G), MIP1a (FIG. 26lI), MIP1B (FIG. 27A), TARC (FIG. 27B), GM-CSF (FIG. 27C), IL-15 (FIG. 27E), IL-16 (FIG. 27F), and IL-15 (FIG. 27I), IL-7 (FIG. 27J).

Example 11: Nanostring-Based Gene Expression Profiling of TCR Vb-Activated T Cells This Example describes gene expression profiling of TCR Vβ-activated T cells to, e.g., uncover potential mechanisms or pathways underlying TCR Vβ activation of T cells.

In a first study, the anti-TCR V013.1 antibody A-H.1 was compared with an anti-CD3 antibody OKT3. Briefly, human PBMCs were isolated from whole blood. From isolated PBMCs, human CD3+ T cells were isolated using magnetic-bead separation (negative selection) (Miltenyi biotec) and activated by immobilized (plate-coated) anti-TCR V013.1 antibody (A-H.1) or anti-CD3 antibody (OKT3) at 100 nM for 6 days. Activated T-cells (from plate-coated) were then prepared for gene expression profiling (PanCancer IO 360™ Panel, nanoString), following manufacturer's protocol. Differential gene expression analysis was grouped by anti-TCR Vβ13.1 (A-H.1) vs anti-CD3 (OKT3) activated T-cells using the nSolver Analysis Software (Nanostring). Data shown in Table 15A are mean values from 3 donors. The differentially regulated genes shown in Table 15A have a p-value of 0.05 or less. In the fourth column of Table 15A showing fold changes in gene expression, a positive value indicates genes that are upregulated at the transcriptional level in TCR Vβ-activated T cells compared to OKT3-activated T cells, whereas a negative value indicates genes downregulated at the transcriptional level in TCR Vβ-activated T cells compared to OKT3-activated T cells.

TABLE 15A

Summary of genes whose expression are preferentially regulated in TCR Vβ-activated T cells compared to OKT3-activated T cells.

| Probe Name | Accession # | NS Probe ID | TCR Vβ13.1 vs OKT3 Fold Change | P value |
|---|---|---|---|---|
| CCR2 | NM_001123041.2 | NM_001123041.2:743 | −3.06 | 0.00019145 |
| LIF | NM_002309.3 | NM_002309.3:1240 | 21.6 | 0.0003319 |
| TCF7 | NM_003202.2 | NM_003202.2:2420 | −8.38 | 0.00037035 |
| PLA2G6 | NM_001004426.1 | NM_001004426.1:1954 | −2.19 | 0.00043564 |
| CD84 | NM_001184879.1 | NM_001184879.1:28 | −3.81 | 0.00062413 |
| ITGB2 | NM_000211.2 | NM_000211.2:520 | −2.11 | 0.0012003 |
| GZMK | NM_002104.2 | NM_002104.2:700 | −11.09 | 0.00135083 |
| HLA-DRB4 | NM_021983.4 | NM_021983.4:194 | −5.75 | 0.00137591 |
| CCR7 | NM_001838.2 | NM_001838.2:1610 | −2.43 | 0.00165716 |
| PDCD1 | NM_005018.1 | NM_005018.1:175 | 7.24 | 0.00195468 |
| CD96 | NM_005816.4 | NM_005816.4:1355 | −6.44 | 0.00221401 |
| SELL | NR_029467.1 | NR_029467.1:1585 | −5 | 0.00227156 |
| NFATC4 | NM_001136022.2 | NM_001136022.2:2296 | −2.75 | 0.0025171 |
| CD8B | NM_004931.3 | NM_004931.3:440 | −3.56 | 0.00302475 |
| NLRC5 | NM_032206.4 | NM_032206.4:860 | −2.27 | 0.00309164 |
| CD1C | NM_001765.2 | NM_001765.2:750 | 8.62 | 0.0035729 |
| HLA-B | NM_005514.6 | NM_005514.6:937 | −1.81 | 0.00363669 |
| NUP107 | NM_020401.2 | NM_020401.2:1002 | 1.64 | 0.00366886 |
| CD3D | NM_000732.4 | NM_000732.4:110 | −2.05 | 0.00401569 |
| HDAC3 | NM_003883.2 | NM_003883.2:1455 | −1.41 | 0.0042794 |
| PRKCE | NM_005400.2 | NM_005400.2:1695 | −1.86 | 0.00429076 |
| HLA-DQB1 | NM_002123.3 | NM_002123.3:384 | −5.71 | 0.00430297 |
| AKT3 | NM_181690.1 | NM_181690.1:755 | −2.98 | 0.00430433 |
| VCAM1 | NM_001078.3 | NM_001078.3:2535 | −23.93 | 0.00464703 |
| CD53 | NM_001040033.1 | NM_001040033.1:835 | −1.7 | 0.00507702 |
| LRP1 | NM_002332.2 | NM_002332.2:4240 | −2.22 | 0.00508974 |
| CD28 | NM_001243078.1 | NM_001243078.1:2065 | −1.73 | 0.00545641 |
| OSM | NM_020530.4 | NM_020530.4:580 | 8.97 | 0.00558554 |
| CLEC4A | NM_194448.2 | NM_194448.2:388 | −1.7 | 0.0056661 |
| MFGE8 | NM_001114614.1 | NM_001114614.1:328 | −2.75 | 0.00633707 |
| IFNAR2 | NM_000874.3 | NM_000874.3:631 | −3.69 | 0.00659279 |
| LTA | NM_000595.2 | NM_000595.2:885 | 6.53 | 0.00727884 |
| ITGAE | NM_002208.4 | NM_002208.4:3405 | −3.42 | 0.00779862 |
| CXCR5 | NM_001716.3 | NM_001716.3:2618 | 4.38 | 0.00781195 |
| CD6 | NM_006725.3 | NM_006725.3:1280 | −1.38 | 0.00848703 |
| ICOS | NM_012092.2 | NM_012092.2:640 | 1.74 | 0.00914866 |
| NOS2A | NM_153292.1 | NM_153292.1:546 | −2.29 | 0.0095337 |
| CD1A | NM_001763.2 | NM_001763.2:1815 | 5.12 | 0.00956367 |
| CD27 | NM_001242.4 | NM_001242.4:330 | −3.41 | 0.00984676 |
| KLRD1 | NM_002262.3 | NM_002262.3:542 | −6.43 | 0.00998325 |
| TARP | NM_001003799.1 | NM_001003799.1:560 | −3.71 | 0.00998698 |
| HLA-DPB1 | NM_002121.4 | NM_002121.4:931 | −8.85 | 0.01064161 |
| PTPRC | NM_080921.3 | NM_080921.3:258 | −2.86 | 0.01124117 |
| CD44 | NM_001001392.1 | NM_001001392.1:429 | −2.07 | 0.01138242 |
| SLAMF6 | NM_001184714.1 | NM_001184714.1:1032 | −1.81 | 0.00175123 |
| HLA-DMB | NM_002118.3 | NM_002118.3:20 | −6.39 | 0.01184625 |

TABLE 15A-continued

Summary of genes whose expression are preferentially regulated in TCR Vβ-activated T cells compared to OKT3-activated T cells.

| Probe Name | Accession # | NS Probe ID | TCR Vβ13.1 vs OKT3 Fold Change | P value |
|---|---|---|---|---|
| CD276 | NM_001024736.1 | NM_001024736.1:2120 | 6.22 | 0.01207813 |
| MAGEA1 | NM_004988.4 | NM_004988.4:476 | −2.93 | 0.01210408 |
| HLA-DMA | NM_006120.3 | NM_006120.3:380 | −5.75 | 0.1210789 |
| EP300 | NM_001429.2 | NM_001429.2:715 | −1.24 | 0.01228626 |
| ADA | NM_000022.2 | NM_000022.2:1300 | −2.97 | 0.01228787 |
| ICAM1 | NM_000201.2 | NM_000201.2:2253 | 2.52 | 0.01290081 |
| SIGIRR | NM_021805.2 | NM_021805.2:469 | −4.46 | 0.01309473 |
| TNF | NM_000594.2 | NM_000594.2:1010 | 4.6 | 0.01318389 |
| IL1RAP | NM_002182.2 | NM_002182.2:460 | 2.77 | 0.01329693 |
| CSF1 | NM_000757.4 | NM_000757.4:823 | 2.55 | 0.01373637 |
| CD40LG | NM_000074.2 | NM_000074.2:1225 | 11.92 | 0.01376174 |
| CYFIP2 | NM_001037332.2 | NM_001037332.2:4043 | −1.38 | 0.01389707 |
| MUC1 | NM_001018017.1 | NM_001018017.1:725 | 3.12 | 0.01399543 |
| HLA-DRB3 | NM_022555.3 | NM_022555.3:698 | −7.11 | 0.01404049 |
| CD2 | NM_001767.3 | NM_001767.3:687 | −1.53 | 0.01432842 |
| IL2RG | NM_000206.1 | NM_000206.1:595 | −1.82 | 0.01477006 |
| HLA-A | NM_002116.5 | NM_002116.5:1000 | −1.96 | 0.01454336 |
| TXK | NM_003328.1 | NM_003328.1:800 | −2.7 | 0.01590341 |
| ITGA4 | NM_000885.4 | NM_000885.4:975 | −3.59 | 0.01601785 |
| DHX16 | NM_001164239.1 | NM_001164239.1:2490 | 1.41 | 0.0167432 |
| CD3E | NM_000733.2 | NM_000733.2:75 | −1.52 | 0.01736902 |
| MR1 | NM_001531.2 | NM_001531.2:7695 | −2.26 | 0.01744764 |
| SMAD3 | NM_005902.3 | NM_005902.3:4220 | −2.82 | 0.01751245 |
| CCRL2 | NM_003965.4 | NM_003965.4:1110 | −1.87 | 0.01834479 |
| HRAS | NM_005343.2 | NM_005343.2:396 | 1.97 | 0.0187379 |
| IL18R1 | NM_003855.2 | NM_003855.2:2025 | 2.36 | 0.01896204 |
| CMA1 | NM_001836.2 | NM_001836.2:561 | −1.96 | 0.01964938 |
| PSMB7 | NM_002799.2 | NM_002799.2:420 | 1.53 | 0.01980367 |
| BCL10 | NM_003921.2 | NM_003921.2:1250 | −1.38 | 0.01981376 |
| HLA-DRA | NM_019111.3 | NM_019111.3:335 | −7.46 | 0.02026993 |
| CD80 | NM_005191.3 | NM_005191.3:1288 | 4.18 | 0.02055337 |
| PIK3CD | NM_005026.3 | NM_005026.3:2978 | −1.23 | 0.02056576 |
| ETS1 | NM_005238.3 | NM_005238.3:4625 | −1.51 | 0.02083359 |
| CHUK | NM_001278.3 | NM_001278.3:860 | 1.67 | 0.0217326 |
| CCL5 | NM_002985.2 | NM_002985.2:280 | −2.47 | 0.02195802 |
| ITGAL | NM_002209.2 | NM_002209.2:3905 | −3 | 0.02244779 |
| TNFRSF18 | NM_004195.2 | NM_004195.2:445 | −3.76 | 0.02330885 |
| EIF2B4 | NM_172195.3 | NM_172195.3:1390 | 1.28 | 0.02349098 |
| CD79A | NM_001783.3 | NM_001783.3:695 | −4.47 | 0.02361746 |
| ABCF1 | NM_001090.2 | NM_001090.2:850 | 1.31 | 0.02452054 |
| CD37 | NM_001774.2 | NM_001774.2:535 | −2.06 | 0.02476513 |
| STAT5B | NM_012448.3 | NM_012448.3:200 | −1.56 | 0.02495121 |
| CSF2 | NM_000758.2 | NM_000758.2:475 | 11.38 | 0.0256982 |
| STAT3 | NM_139276.2 | NM_139276.2:4535 | −1.47 | 0.02629936 |
| GZMA | NM_006144.2 | NM_006144.2:155 | −2.46 | 0.02646368 |
| CIR | NM_001733.4 | NM_001733.4:760 | −3.1 | 0.02653879 |
| MIF | NM_002415.1 | NM_002415.1:319 | −1.38 | 0.02690018 |
| CD46 | NM_172350.1 | NM_172350.1:365 | −1.36 | 0.02725208 |
| PIK3CG | NM_002649.2 | NM_002649.2:2125 | −2.34 | 0.02762105 |
| CFB | NM_001710.5 | NM_001710.5:2029 | −2.59 | 0.02802998 |
| IL3 | NM_000588.3 | NM_000588.3:130 | 13.37 | 0.02820076 |
| TNFRSF13C | NM_052945.3 | NM_052945.3:789 | −2.2 | 0.02835259 |
| MRPS5 | NM_031902.3 | NM_031902.3:390 | 1.2 | 0.02849936 |
| TUBB | NM_178014.2 | NM_178014.2:320 | 1.06 | 0.02874459 |
| PECAM1 | NM_000442.3 | NM_000442.3:1365 | −4.35 | 0.02901845 |
| PVR | NM_006505.3 | NM_006505.3:604 | 2.28 | 0.0299334 |
| AMICA1 | NM_153206.2 | NM_153206.2:620 | −2.38 | 0.03034954 |
| CD74 | NM_001025159.1 | NM_001025159.1:964 | −3.28 | 0.0305419 |
| ENTPD1 | NM_001098175.1 | NM_001098175.1:8830 | −8.02 | 0.03085618 |
| CD97 | NM_078481.2 | NM_078481.2:1370 | −1.56 | 0.03086014 |
| KLRK1 | NM_007360.3 | NM_007360.3:522 | −4.16 | 0.03108504 |
| HLA-DQA1 | NM_002122.3 | NM_002122.3:261 | −5.51 | 0.03126291 |
| CD247 | NM_198053.1 | NM_198053.1:1490 | −1.88 | 0.03182703 |
| IFNG | NM_000619.2 | NM_000619.2:970 | 5.98 | 0.03202586 |
| SAA1 | NM_199161.1 | NM_199161.1:135 | −2.35 | 0.03341258 |
| TBX21 | NM_013351.1 | NM_013351.1:890 | 1.92 | 0.03359165 |
| RORA | NM_134261.2 | NM_134261.2:1715 | −2.57 | 0.03591525 |
| MASP2 | NM_139208.1 | NM_139208.1:330 | −1.65 | 0.03611762 |
| CLU | NM_001831.2 | NM_001831.2:2340 | −1.55 | 0.0369776 |
| KLRB1 | NM_002258.2 | NM_002258.2:85 | −7.43 | 0.03705134 |
| RELA | NM_021975.2 | NM_021975.2:360 | −1.26 | 0.03765981 |
| SLAMF1 | NM_003037.2 | NM_003037.2:580 | 1.82 | 0.03768168 |

TABLE 15A-continued

Summary of genes whose expression are preferentially regulated in TCR Vβ-activated T cells compared to OKT3-activated T cells.

| Probe Name | Accession # | NS Probe ID | TCR Vβ13.1 vs OKT3 Fold Change | P value |
|---|---|---|---|---|
| CD8A | NM_001768.5 | NM_001768.5:1320 | -4.49 | 0.0380276 |
| IL11RA | NM_147162.1 | NM_147162.1:400 | -3.54 | 0.03855863 |
| CD3G | NM_000073.2 | NM_000073.2:404 | -1.44 | 0.03877635 |
| JAK1 | NM_002227.1 | NM_002227.1:285 | -1.84 | 0.4001383 |
| SPN | NM_003123.3 | NM_003123.3:2345 | -1.72 | 0.04035383 |
| CXCR4 | NM_003467.2 | NM_003467.2:1335 | -3.03 | 0.04122601 |
| FAS | NM_000043.3 | NM_000043.3:90 | -2.37 | 0.04150638 |
| IL2 | NM_000586.2 | NM_000586.2:300 | 10.9 | 0.04175377 |
| ITGA1 | NM_181501.1 | NM_181501.1:1875 | -2.75 | 0.04213304 |
| IGF1R | NM_000875.2 | NM_000875.2:455 | -1.94 | 0.0424234 |
| CLEC6A | NM_001007033.1 | NM_001007033.1:342 | -2.83 | 0.04299769 |
| RPS6 | NM_001010.2 | NM_001010.2:171 | -1.36 | 0.04334091 |
| MAPK11 | NM_002751.5 | NM_002751.5:1310 | -1.98 | 0.04344288 |
| REL | NM_002908.2 | NM_002908.2:225 | -2.37 | 0.04382344 |
| EOMES | NM_005442.2 | NM_005442.2:1670 | -6.49 | 0.04442535 |
| KLRG1 | NM_005810.3 | NM_005810.3:65 | -3.52 | 0.04487411 |
| IL2RA | NM_000417.1 | NM_000417.1:1000 | 3.4 | 0.0457568 |
| IFNA17 | NM_021268.2 | NM_021268.2:291 | -3.13 | 0.04595868 |
| SH2D1B | NM_053282.4 | NM_053282.4:545 | -1.44 | 0.04640447 |
| CCL2 | NM_002982.3 | NM_002982.3:123 | 4.01 | 0.04660539 |
| TXNIP | NM_006472.1 | NM_006472.1:255 | -4.07 | 0.04695375 |
| CXCL13 | NM_006419.2 | NM_006419.2:210 | -65.05 | 0.04708191 |
| CASP8 | NM_001228.4 | NM_001228.4:301 | -1.42 | 0.04720592 |
| MTMR14 | NM_022485.3 | NM_022485.3:720 | -1.25 | 0.04798024 |
| MAP3K5 | NM_005923.3 | NM_005923.3:1760 | -1.62 | 0.04838454 |
| ADORA2A | NM_000675.3 | NM_000675.3:1095 | 1.3 | 0.04872028 |
| CCR5 | NM_000579.1 | NM_000579.1:2730 | -4.01 | 0.04885927 |

In a second study, the multispecific anti-TCR Vβ13.1/anti-BCMA antibody Molecule H was compared with the anti-CD3 antibody OKT3. Purified T cells were stimulated with solid-phase anti-TCR Vβ antibody over 6 days with the anti-TCR Vβ antibody Molecule H or anti-CD3e antibody (OKT3) at 100 nM. Expanded T cells were collected by centrifugation followed by RNA extraction. Seven hundred and seventy eight (778) immunology-related genes were counted using the nCounter Technology (Nanostring) followed by gene expression analysis using nSolver analysis tools. The data described in this Example is representative of 3 donors.

Based on this analysis, a panel of genes were identified as being differentially regulated in TCR Vβ-activated T cells compared to OKT3-activated T cells (Table 15B). The differentially regulated genes shown in Table 15B have a p-value of 0.05 or less. For example, LIF, CD40LG, PDCD1, CXCR5, LTA, and CD80 are all upregulated at the transcriptional level in TCR Vβ-activated T cells compared to OKT3-activated T cells. GZMK, ENTPD1 (CD39), TCF7, CD96, HLA-DRB4, SIGIRR and SELL are down-regulated at the transcriptional level in TCR Vβ-activated T cells compared to OKT3-activated T cells. TCR Vβ-activated T cells also expressed high levels of cytolytic effectors (e.g., IFNg, Granzyme B and perforin).

TABLE 15B

Summary of genes whose expression are preferentially regulated in TCR Vβ-activated T cells compared to OKT3-activated T cells.

| Gene | Description | Log$_2$ Fold Change | P-Value |
|---|---|---|---|
| LIF | LIF Interleukin 6 Family Cytokine | 4.65 | 0.0119 |
| GZMK | Granzyme K | -3.65 | 0.0468 |
| CD40LG | CD40 Ligand | 3.56 | 0.0082 |
| ENTPD1 (CD39) | Ectonucleoside Triphosphate Diphosphohydrolase 1 | -3.53 | 0.0541 |
| PDCD1 | Programmed Cell Death 1 | 3.19 | 0.0257 |
| TCF7 | Transcription Factor 7 | -3.1 | 0.00634 |
| CXCR5 | Chemokine receptor for CXCL13 | 3.05 | 0.0337 |
| CD96 | Transmembrane glycoprotein Ig superfamily receptor, interacts with nectin and nectin-like proteins, including CD155/polio virus receptor (PVR) | -2.75 | 0.007 |

TABLE 15B-continued

Summary of genes whose expression are preferentially regulated in TCR Vβ-activated T cells compared to OKT3-activated T cells.

| Gene | Description | Log$_2$ Fold Change | P-Value |
|---|---|---|---|
| LTA | Lymphotoxin Alpha | 2.67 | 0.0082 |
| HLA-DRB4 | Major Histocompatibility Complex, Class II, DR Beta 4 | −2.66 | 0.0377 |
| CD80 | T cell costimulatory molecule | 2.58 | 0.0425 |
| SIGIRR | Single Ig And TIR Domain Containing | −2.37 | 0.0227 |
| SELL | Selection L | −2.3 | 0.00634 |

Example 12: Binding Affinity of Affinity Matured Humanized Antibody A-H Antibodies This Example describes the evaluation of binding affinity of affinity matured humanized Antibody A-H antibodies to recombinant protein TCRVB 6-5.

Antibody A-H humanized antibodies were affinity matured. The resulting affinity matured antibodies were tested for their binding affinity to TCRVB 6-5 as described below.

TCRVB 6-5 at 5 ug/mL was immobilized on a Biotin CAP Series S Sensor Chip to 60 RU. BJM0277 was diluted to 200 nM and then serially diluted two fold. Association was 120 seconds, and dissociation was 300 seconds. This assay was run in 1×HBS-EP+ Buffer pH 7.4 and 25 C. The data was fit using a 1:1 binding model.

TCRVB 6-5 at 5 ug/mL was immobilized on a Biotin CAP Series S Sensor Chip to 60 RU. A-H.45 was diluted to 50 nM and then serially diluted two fold. Association was 120 seconds, and dissociation was 300 seconds. This assay was run in 1×HBS-EP+ Buffer pH 7.4 and 25 C. The data was fit using a 1:1 binding model. A-H.45 is an improved yeast clone (TCRvB/CD19 bispecific) and contains a mutation (G to V) at the last residue in framework 3, just before HCDR3. The affinity is 35-fold greater than the BJM0277 (Table 16).

TCRVB 6-5 at 5 ug/mL was immobilized on a Biotin CAP Series S Sensor Chip to 60 RU. A-H.52 was diluted to 50 nM and then serially diluted two fold. Association was 120 seconds, dissociation was 300 seconds. This assay was run in 1×HBS-EP+ Buffer pH 7.4 and 25 C. The data was fit using a 1:1 binding model. A-H.52 is a phage clones and is a monovalent scFv. A-H.52 has two mutations on CDRH1. The affinity of A-H.52 is 20-fold greater than BJM0277 (Table 16).

TCRVB 6-5 at 5 ug/mL was immobilized on a Biotin CAP Series S Sensor Chip to 60 RU. A-H.53 was diluted to 50 nM and then serially diluted two fold. Association was 120 seconds, dissociation was 300 seconds. This assay was run in 1×HBS-EP+ Buffer pH 7.4 and 25 C. The data was fit using a 1:1 binding model. A-H.53 (phage clone) affinity is in the pM range (Table 16). The affinity of A-H.53 is 200-fold greater than BJM0277 (Table 16).

TCRVB 6-5 at 5 ug/mL was immobilized on a Biotin CAP Series S Sensor Chip to 60 RU. A-H.54 was diluted to 50 nM and then serially diluted two fold. Association was 120 seconds, and dissociation was 300 seconds. This assay was run in 1×HBS-EP+ Buffer pH 7.4 and 25 C. The data was fit using a 1:1 binding model. A-H.54 (phage clone) affinity is 17-fold greater than BJM0277 (Table 16).

TABLE 16

Summary of affinity maturation of anti-TCRVb antibodies

| Construct | Target: TCRVβ 6-5 |
|---|---|
| BJM0277 | 35 nM |
| A-H.45 | 1.08 Nm |
| A-H.52 | 1.76 nM |
| A-H.53 | 165 pM |
| A-H.54 | 2.22 nM |

Example 13: Therapeutic Efficacy of CD19/TCRvB Bispecific Molecules in Subcutaneous Human Tumor Xenograft Models This Example demonstrates the in vivo efficacy of a CD19/TCRvB Bispecific molecule in a subcutaneous human tumor animal model.

On day 1 of the study 1×10$^6$ cells of the human cancer cell line Raji, stably expressing firefly luciferase (Raji-luc) were subcutaneously injected in the right dorsal flank of female NOD/SCID/IL-2Rγnull (NSG) mice. On day 3, 10×10$^6$ human PBMCs were transplanted into mice by injection into the peritoneal cavity.

Antibody treatment started at day 10, when tumors had reached a mean tumor volume (TV) of 80 mm$^3$. Mean TV of each group was not statistically different from any other group at start of treatment. Mice were treated with 0.2 mg/kg, 1 mg/kg and 5 mg/kg of CD19/TCRvB bispecific molecule every three days for a total of 7 doses by intravenous bolus injection. Tumor volume (TV) was measured every 3 days by calipers and progress evaluated by intergroup comparison of TV. Tumor growth inhibition T/C [%] was calculated as T/C[%]=100×(mean TV of analyzed group)/(mean TV of vehicle group).

Figure 28:
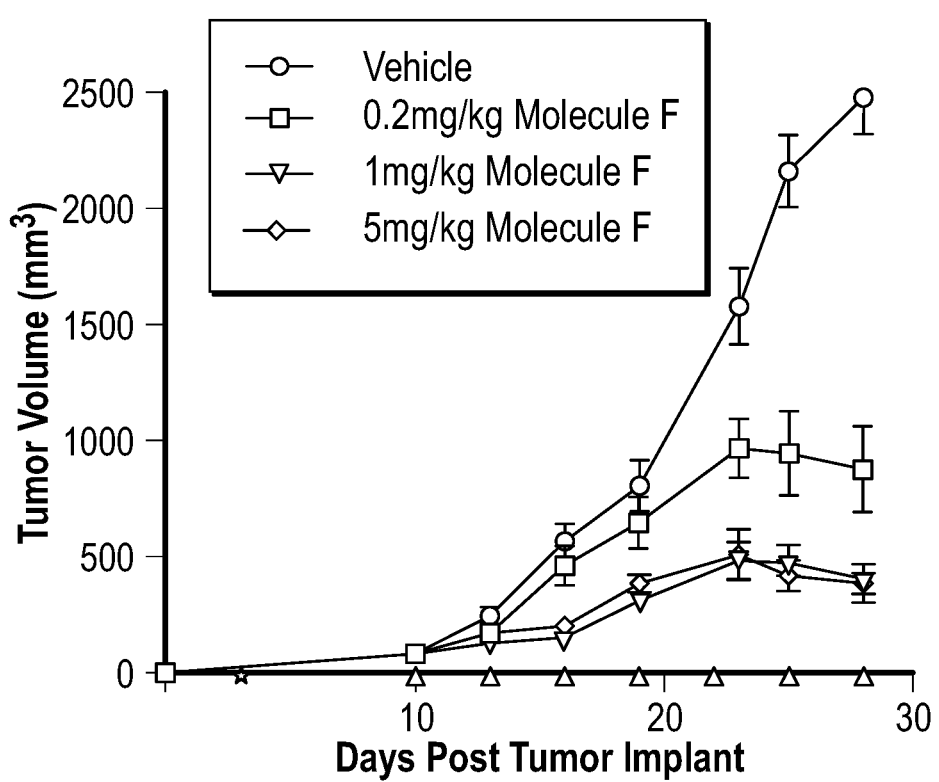
FIG. 28 is a graph depicting mean tumor volume in NOD/SCID/IL-2Rγnull (NSG) mice engrafted with Raji-luc cells at days 10 to 28. The Star denotes PBMC implantation. Open triangles denote antibody treatment with the indicated antibodies.

Results are shown in Table 17 and FIG. 28. Treatment with the CD19/TCRvB Bispecific molecule inhibited tumor growth compared to vehicle control treatment (FIG. 28). The results demonstrate that the CD19/TCRvB bispecific molecule inhibits tumor growth and has anti-tumor activity.

TABLE 17

Mean tumor volume and tumor growth inhibition (T/C) at days 10 to 28.

| Dose group | Data | D10 | D13 | D16 | D19 | D23 | D25 | D28 |
|---|---|---|---|---|---|---|---|---|
| Vehicle | TV (mm³) | 84 | 241 | 566 | 802 | 1577 | 2161 | 2478 |
| | T/C [%] | 100 | 100 | 100 | 100 | 100 | 100 | 100 |
| 0.2 mg/kg CD19/TCRvB | TV (mm³) | 82 | 169 | 460 | 643 | 967 | 946 | 875 |
| | T/C [%] | 98 | 70 | 81 | 80 | 61 | 44 | 35 |
| 1 mg/kg CD19/TCRvB | TV (mm³) | 82 | 122 | 147 | 307 | 482 | 469 | 406 |
| | T/C [%] | 98 | 51 | 26 | 38 | 31 | 22 | 16 |
| 5 mg/kg CD19/TCRvB | TV (mm³) | 79 | 160 | 200 | 381 | 510 | 409 | 382 |
| | T/C [%] | 94 | 66 | 35 | 48 | 32 | 19 | 15 |

Example 14: Therapeutic Efficacy of CD19/TCRvB Bispecific Molecules in Human Tumor Xenograft Models This Example demonstrates the in vivo efficacy of a CD19/TCRvB Bispecific molecules in a xenograft animal model.

On day 1 of the study $10 \times 10^6$ human PBMCs were transplanted into NOD/SCID/IL-2Rγnull (NSG) mice by injection into the peritoneal cavity. On day 7, $1 \times 10^6$ cells of the human cancer cell line Raji, stably expressing firefly luciferase (Raji-luc) were intravenously injected into NOD/SCID/IL-2Rγnull (NSG) mice. Control animals were injected with $10 \times 10^6$ cells of the CD19 negative human cancer cell line K562 stably expressing firefly luciferase (K562-luc). These animals were used to assess specific killing ability of CD19/TCRvB molecules. Antibody treatment started at day 16, when tumor engraftment had reached a mean bioluminescence flux level of $4 \times 10^7$ photons/s. Mean Flux level of each group was not statistically different from any other group at start of treatment. Mice were treated with 1 mg/kg and 5 mg/kg of CD19/TCRvB bispecific molecule every three days for a total of 6 doses by intravenous bolus injection.

Tumor burden was measured weekly by bioluminescence imaging and progress evaluated by intergroup comparison of total bioluminescence flux (Total Flux). Tumor growth inhibition T/C [%] was calculated as T/C[%]=100×(mean Total Flux of analyzed group)/(mean Total Flux of vehicle group).

Figure 29A:
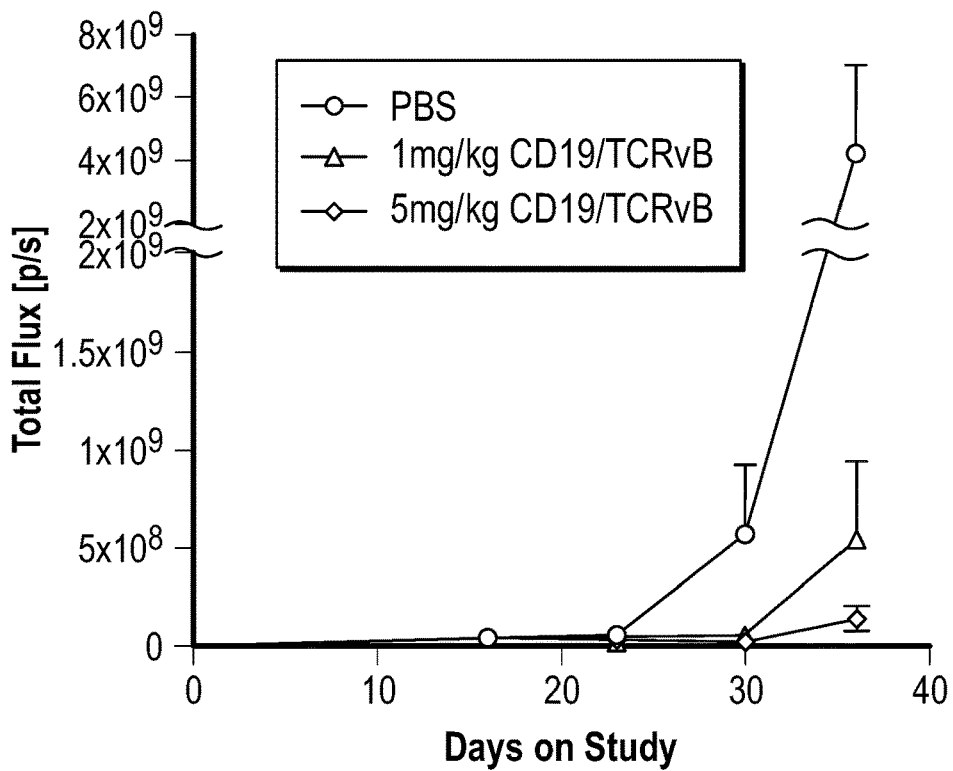
FIGS. 29A-B depicting Mean tumor burden (Total Flux) in NOD/SCID/IL-2Rγnull (NSG) mice engrafted with cancer cells and treated with the indicated antibody. NSG mice were implanted with PBMCs on Day 1 followed by injection with cancer cells on Day 7 (Raji-luc in FIG. 29A; K562-Luc control in FIG. 29B). Antibody treatment with the indicated antibodies began on Day 16.
Figure 29B:
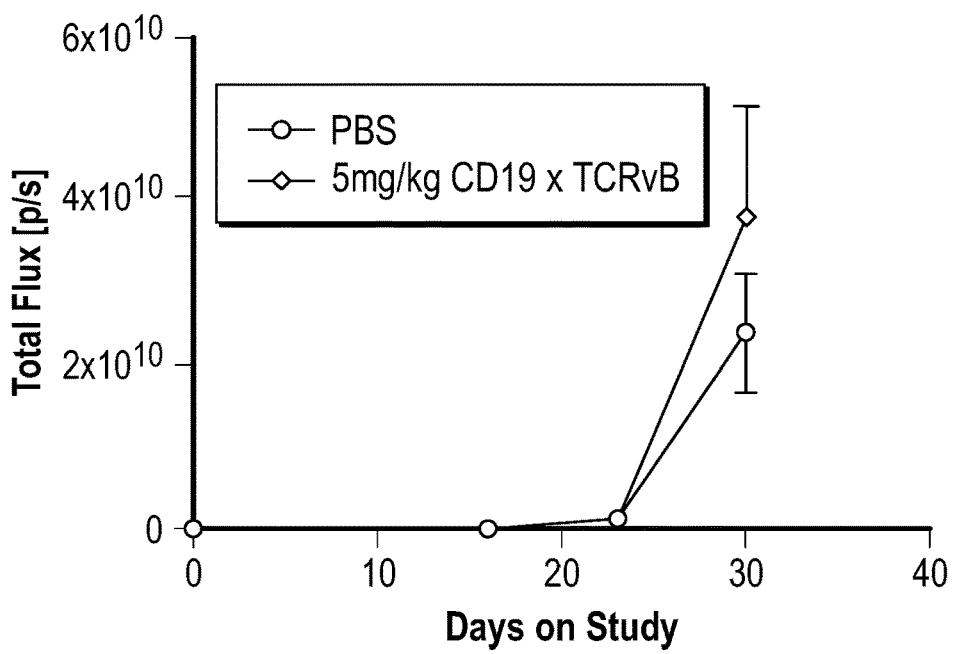

The results for Raji-luc engrafted animals are shown in Table 18 and FIG. 29A and results for K562-luc engrafted animals are shown in Table 19 and FIG. 29B. The results demonstrate that the CD19/TCRvB bispecific molecule inhibits tumor growth and has anti-tumor activity (FIG. 29A and Table 18).

TABLE 18

Mean tumor burden (Total Flux) and tumor growth inhibition (T/C) at days 16 to 37 in animals engrafted with Raji-luc cells

| Dose group | Data | D16 | D23 | D30 | D37 |
|---|---|---|---|---|---|
| Vehicle | Total Flux (p/s) | 4.26E+07 | 5.92E+07 | 5.77E+08 | 4.23E+09 |
| | T/C [%] | 100 | 100 | 100 | 100 |
| 1 mg/kg CD19/TCRvB | Total Flux (p/s) | 4.05E+07 | 2.66E+07 | 5.03E+07 | 5.42E+08 |
| | T/C [%] | 95.0 | 44.9 | 8.7 | 12.8 |
| 5 mg/kg CD19/TCRVB | Total Flux (p/s) | 4.18E+07 | 3.10E+07 | 2.37E+07 | 1.44E+08 |
| | T/C [%] | 98.0 | 52.3 | 4.1 | 3.4 |

TABLE 19

Mean tumor burden (Total Flux) and tumor growth inhibition (T/C) at days 16 to 30 in animals engrafted with K562-luc cells

| Dose group | Data | D16 | D23 | D30 |
|---|---|---|---|---|
| Vehicle | Total Flux (p/s) | 2.98E+07 | 9.94E+08 | 2.40E+10 |
| | T/C [%] | 100 | 100 | 100 |
| 5 mg/kg CD19/TCRvB | Total Flux (p/s) | 2.00E+07 | 1.22E+09 | 3.82E+10 |
| | T/C [%] | 67.0 | 122.4 | 159.4 |

Example 15: Therapeutic Efficacy of BCMA/TCRvB Bispecific Molecules in Human Tumor Xenograft Models This Example demonstrates the in vivo efficacy of a BCMA/TCRvB Bispecific molecule in a xenograft animal model.

On day 1, $20 \times 10^6$ cells of the human cancer cell line RPMI-8226, stably expressing firefly luciferase (RPMI-8226-luc) were intravenously injected into NOD/SCID/IL-2Rγnull (NSG) mice. On day 11, $10 \times 10^6$ human PBMCs were transplanted into mice by injection into the peritoneal cavity. Antibody treatment started at day 17, when tumor engraftment had reached a mean bioluminescence flux level of $4 \times 10^7$ photons/s. Mice were treated with 0.5 mg/kg of a molecule bivalent for both BCMA and TCRvB (2 ×2 molecule) and 0.5 mg/kg of a molecule bivalent for BCMA and monovalent for TCRvB (2 ×1 molecule) once a week for a total of 2 doses by intravenous bolus injection.

Tumor burden was measured weekly by bioluminescence imaging and progress evaluated by intergroup comparison of total bioluminescence flux (Total Flux). Tumor growth inhibition T/C [%] was calculated as T/C[%]=100×(mean Total Flux of analyzed group)/(mean Total Flux of vehicle group).

Figure 30:
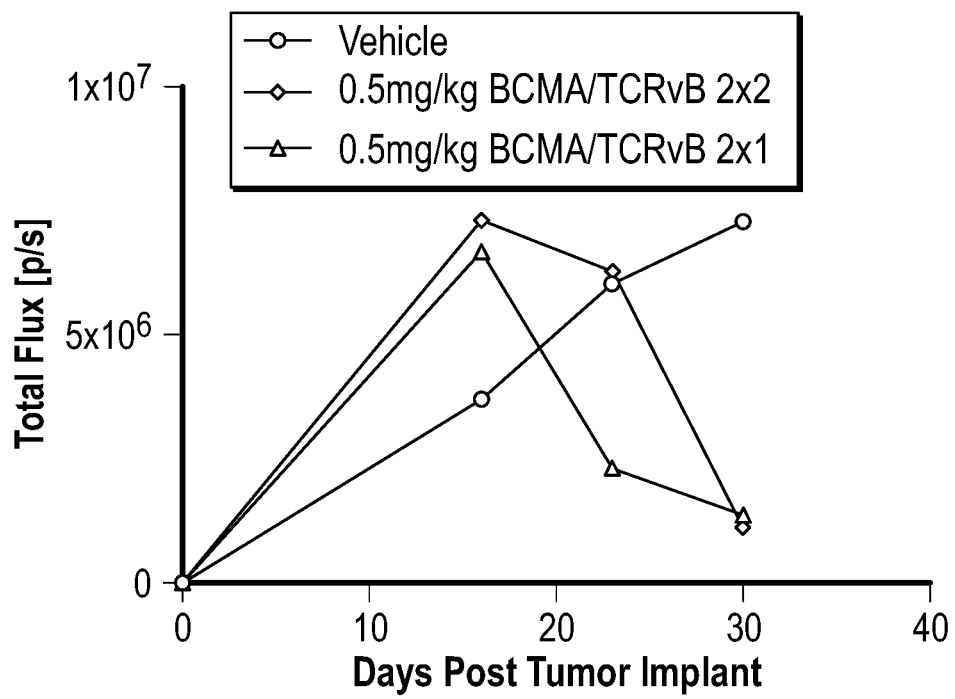
FIG. 30 is a graph depicting Mean tumor burden (Total Flux) mean tumor volume in NOD/SCID/IL-2Rγnull (NSG) mice engrafted with RPMI-8226 cells. The RPMI-8226 cells were engrafted on Day 1. On Day 11, PBMCs were implanted into the mice and antibody treatment began on Day 17.

Results of these studies are shown in Table 20 and FIG. 30. Treatment with the BCMA/TCRvB Bispecific molecule inhibited tumor growth compared to vehicle control treatment (FIG. 29). The results demonstrate that the BCMA/TCRvB bispecific molecule inhibits tumor growth and has anti-tumor activity.

TABLE 20

Mean tumor burden (Total Flux) and tumor growth inhibition (T/C) at days 16 to 30.

| Dose group | Data | D16 | D23 | D30 |
|---|---|---|---|---|
| Vehicle | Total Flux (p/s) | 3.71E+06 | 6.04E+06 | 7.29E+06 |
| | T/C [%] | 100 | 100 | 100 |

TABLE 20-continued

Mean tumor burden (Total Flux) and tumor growth inhibition (T/C) at days 16 to 30.

| Dose group | Data | D16 | D23 | D30 |
|---|---|---|---|---|
| 0.5 mg/kg BCMA/TCRvB 2 × 2 | Total Flux (p/s) | 7.33E+06 | 6.30E+06 | 1.13E+06 |
|  | T/C [%] | 197.7 | 104.3 | 15.5 |
| 0.5 mg/kg BCMA/TCRvB 2 × 1 | Total Flux (p/s) | 3.66E+06 | 3.15E+06 | 5.65E+05 |
|  | T/C [%] | 98.8 | 52.1 | 7.8 |

Example 16: Expression and Purification of Antibody Constructs

Construction of the Plasmids

The DNA encoding the protein sequences was optimized for expression in *Cricetulus griseus*, synthesized, and cloned into the pcDNA3.4-TOPO (Life Technologies A14697) using Gateway cloning. All constructs contained an Ig Kappa leader sequence METDTLLLWVLLLWVPGSTG (SEQ ID NO: 3288).

Expression and Purification

The plasmids were co-transfected into either Expi293 cells (Life Technologies A14527) or ExpiCHO cells (Life Technologies A29127). Transfections were performed using 1 mg of total DNA for a multi specific construct with a 1:1 heavy chain ratio and 3:2 light chain to heavy chain ratio if applicable. Transfection in Expi293 cells was done using linear 25,000 Da polyethylenimine (PEI, Polysciences Inc 23966) in a 3:1 ratio with the total DNA. The DNA and PEI were each added to 50 mL of OptiMem (Life Technologies 31985088) medium and sterile filtered. The DNA and PEI were combined for 10 minutes and added to the Expi293 cells with a cell density of 1.8-2.8×10$^6$ cells/mL and a viability of at least 95%. The ExpiCHO transfection was performed according to the manufacturer's instructions. Expi293 cells were grown in a humidified incubator at 37° C. with 8% $CO_2$ for 5-7 days after transfection and ExpiCHO cells were grown for 14 days at 32° C. with 5% $CO_2$. The cells were pelleted by centrifugation at 4500×g and the supernatant was filtered through a 0.2 μm membrane. Protein A resin (GE 17-1279-03) was added to the filtered supernatant and incubated for 1-3 hours at room temperature. The resin was packed into a column, washed with 3 ×10 column volumes of Dulbecco's phosphate-buffered saline (DPBS, Life Technologies 14190-144). The bound protein was eluted from the column with 20 mM citrate, 100 mM NaCl, pH 2.9. When necessary, the proteins were further purified using ligand affinity and/or size exclusion chromatography on a Superdex 200 column with a running buffer of DPBS.

Example 17: Humanization of Anti-TRBV5-5 Antibody Clone Antibody C

The germline for the mouse anti-TCRvbeta antibody clone Antibody C VH and VL were assigned using IMGT nomenclature, with CDR regions defined by a combined Kabat and Chothia classification. SEQ ID NO: 232 and SEQ ID NO: 233 are the Antibody C VH and VL sequences respectively where the VH germline is mouse IGHV2-6-7*01 and the VL germline is mouse IGKV10-94*02. The method applied to humanize Antibody A described in Example 1 was used to humanize Antibody C. The Antibody C VH was humanized into human IGHV2-26*01, IGHV2-70*04, IGHV4-4*02, IGHV2-5*09, IGHV2-5*08, IGHV4-34*09, IGHV4-59*01, IGHV4-59*07, IGHV4-61*02, IGHV4-38-2*01, IGHV4-31*01, IGHV3-49*04, IGHV3-49*02, IGHV4-4*07, IGHV3-49*05, IGHV4-34*10, IGHV4-28*04, IGHV3-72*01, IGHV3-15*07, IGHV6-1*01, IGHV3-7*01, IGHV4-34*01, IGHV3-33*02, IGHV3-48*02, IGHV3-23*03, IGHV3-21*01, IGHV3-73*01, IGHV3-30*02, IGHV3-7*01, IGHV3-43*01, and IGHV3-53*03 and the Antibody C VL was humanized into human IGKV1D-43*01, IGKV1-27*01, IGKV1-17*02, IGKV1-17*01, IGKV1-5*01, IGKV4-1*01, IGKV3-7*02, IGKV3-7*01, IGKV2-29*02, IGKV6D-41*01, IGKV2-28*01, IGKV2-40*01, IGKV3-15*01, IGKV2-24*01, IGKV6-21*01, IGKV2D-26*01, and IGKV2D-26*03.

SEQ ID NOs: 3040-3089 are the Antibody C humanized heavy chains and SEQ ID NOs: 3000-3039 are the Antibody C humanized light chains (as described in Table 10).

Example 18: Humanization of TRBV10-1, TRBV10-2, and TRBV10-3 Antibody Clone Antibody D The germline for the mouse anti-TCRvbeta antibody clone Antibody D VH and VL were assigned using IMGT nomenclature, with CDR regions defined by a combined Kabat and Chothia classification. SEQ ID NO: 3183 and SEQ ID NO: 3184 are the Antibody D VH and VL sequences respectively where the VH germline is mouse IGHV5-6*01 and the VL germline is mouse IGKV4-59*01.

The method applied to humanize Antibody A described in Example 1 was used to humanize Antibody D. The Antibody D VH was humanized into human IGHV3-30*03, IGHV3-30*02, IGHV3-7*01, IGHV3-21*01, IGHV3-23*04, IGHV3-30*15, IGHV3-48*02, IGHV3-53*04, IGHV3-23*03, IGHV3-53*03, IGHV3-53*01, IGHV3-9*01, IGHV3-30*13, IGHV3-20*01, IGHV3-43D*03, IGHV3-43*02, IGHV3-43*01, IGHV3-53*02, IGHV3-13*01, IGHV3-38-3*01, IGHV3-9*03, IGHV3-64D*06, IGHV3-33*02, IGHV3-11*03, IGHV3-64*02, IGHV3-64*01, IGHV3-64*03, IGHV3-7*01, IGHV3-35*01, IGHV3-13*02, IGHV3-38*02, and IGHV3-38*01 and the Antibody D VL was humanized into human IGKV3-11*01, IGKV1-13*02, IGKV1-9*01, IGKV6-21*01, IGKV1D-43*01, IGKV3-11*01, IGKV3D-11*02, IGKV1-17*03, IGKV3D-20*01, IGKV3-20*01, IGKV1D-16*01, IGKV4-1*01, IGKV2-28*01, IGKV2-40*01, IGKV2-29*02, IGKV2-29*01, IGKV1D-42*01, IGKV2-24*01, and IGKV5-2*01. SEQ ID NOs: 3225-3274 are the Antibody D humanized heavy chains and SEQ ID NOs: 3185-3224 are the Antibody D humanized light chains (as described in Table 12).

Example 19: Humanization of TRBV5-5 and TRBV5-6 Antibody Clone Antibody E

The germline for the mouse anti-TCRβ antibody clone Antibody E VH and VL were assigned using IMGT nomenclature, with CDR regions defined by a combined Kabat and Chothia classification. SEQ ID NO: 3091 and SEQ ID NO: 3092 are the Antibody E VH and VL sequences respectively where the VH germline is mouse IGHV1-82*01 and the VL germline is mouse IGKV3-5*01.

The method applied to humanize Antibody A described in Example 1 was used to humanize Antibody E. The Antibody E VH was humanized into human IGHV1-69*08, IGHV1-3*02, IGHV1-18*03, IGHV1-3*01, IGHV1-18*01, IGHV1-2*06, IGHV1-2*01, IGHV1-2*06, IGHV1-8*01, IGHV7-4-1*02, IGHV1-58*02, IGHV5-51*01, IGHV7-4-1*04, IGHV7-81*01, IGHV5-51*04, IGHV5-51*01, IGHV1-45*03, IGHV3-49*04, IGHV3-49*02, IGHV3-49*05, IGHV4-4*02, IGHV3-49*05, IGHV3-73*01, IGHV4-4*02, IGHV3-15*07, IGHV3-15*02, IGHV3-72*01, IGHV4-59*07, IGHV4-31*01, IGHV4-31*02, IGHV3-30*15, IGHV3-21*01, IGHV3-7*01, IGHV4-28*01, IGHV4-28*02, IGHV3-30*08, IGHV3-30*05, and IGHV3-30*01 and the Antibody E VL was humanized into human IGKV4-1*01, IGKV3-11*01, IGKV3-20*02, IGKV3-11*01, IGKV1-13*02, IGKV3D-11*01, IGKV3D-20*02, IGKV1-13*02, IGKV3D-20*01, IGKV1-9*01, IGKV3D-15*03, IGKV3-15*01, IGKV1-5*01, IGKV2D-29*01, IGKV3-7*02, IGKV1-9*01, IGKV2-28*01, IGKV2-40*01, IGKV2D-29*02, IGKV3-7*01, IGKV2-30*01, IGKV2-24*01, IGKV6D-41*01, IGKV1D-42*01, IGKV2D-26*01, IGKV2D-26*03, and IGKV5-2*01. SEQ ID NOs: 3133-3182 are the Antibody E humanized heavy chains and SEQ ID NOs: 3093-3132 are the Antibody E humanized light chains (as described in Table 11).

Figure 31A:
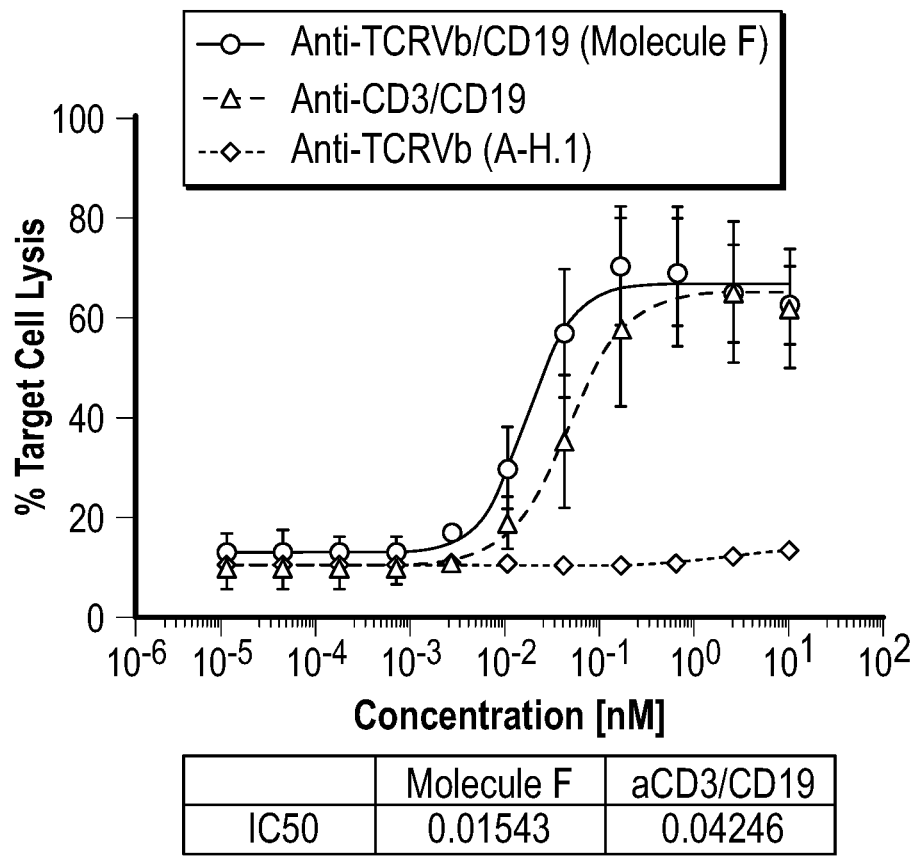
FIGS. 31A-31B are graphs showing % target cell lysis at different antibody concentrations.

Example 20: In Vitro Cytotoxicity of an Anti-TCRVb/CD19 Antibody Molecule and an Anti-TCRVb/BCMA Antibody Molecule Anti-TCR/Anti-CD19 Dual Targeting Antibody Molecule Human PBMCs were isolated from whole blood. From isolated PBMCs, human CD3+ T cells were isolated using magnetic-bead separation (negative selection) (Miltenyi biotec) and activated by immobilized (plate-coated) anti-TCR Vβ13.1 (A-H.1) at 100 nM for 6 days. Activated T-cells (from plate-coated) were then transferred and expanded in tissue culture flask in the presence of human IL-2 at a concentration of 50 U/ml for two additional days. Expanded TCR Vβ13.1+ cells were washed and co-cultured in the presence of CD19-expressing Raji cells (target cells) at an E:T ratio of 5:1 and serial diluted concentrations of T-cell engager bispecific antibodies including, anti-TCR Vβ13.1/CD19 (Molecule F), anti-CD3/CD19, and anti-TCR Vβ13.1 (A-H.1, serving as control) for 24 hours. Post 24 hours, cell co-culture supernatants were collected and quantified for specific target cell death. Target cells (Raji cells) are a KILR-retroparticles reporter cell assay (DiscoverX). KILR-Raji target cells are engineered to stably express a protein tagged with enhanced ProLabel (ePL), a β-gal reporter fragment, using the KILR Retroparticles, and when the membrane of the target cells is compromised due to cell death, the target cells will release the tagged protein into the media. This KILR reporter protein can be detected in the media/supernatant by the addition of detection reagents containing the enzyme acceptor (EA) fragment of the β-gal reporter. This leads to the formation of the active β-gal enzyme which hydrolyzes the substrate to give a chemiluminescent output (RUT). Percentage (%) of target cell death is calculated using the following formula:

$(RLU_{Treatment} - RLU_{No\ Treatment}) / (RLU_{Maximum\ Lysis} - RLU_{No\ Treatment}) \times 100$ Data shown in FIG. 31A are mean values from 4 donors.

Anti-TCR/Anti-BCMA Dual Targeting Antibody Molecule

Figure 31B:
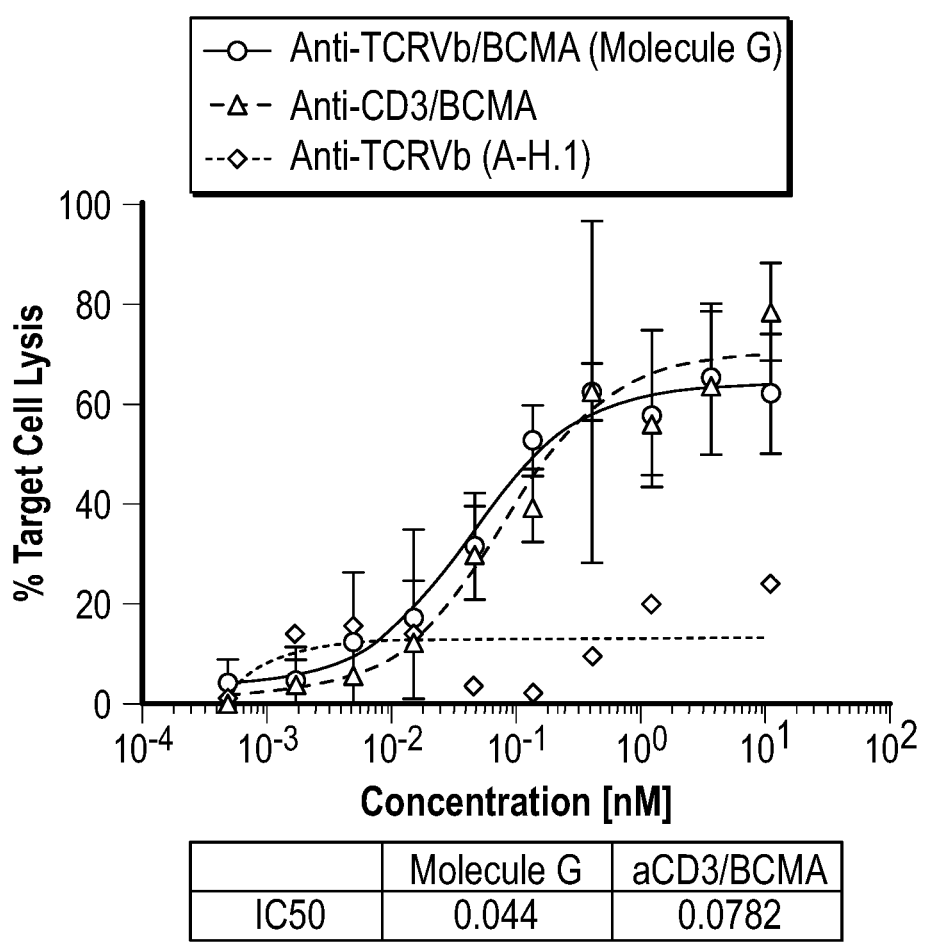
Figures 32C, 32D:
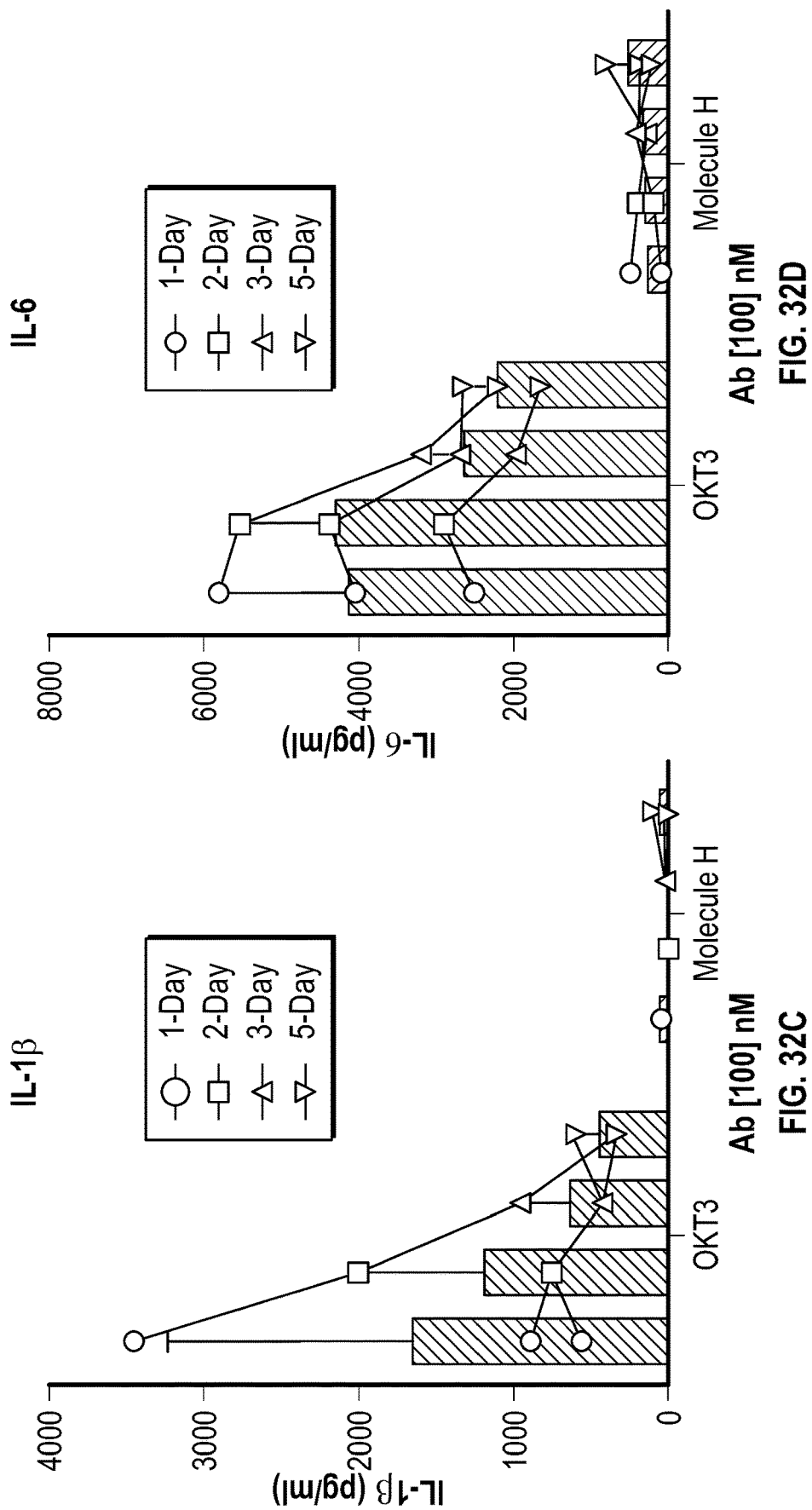
Figure 33A:
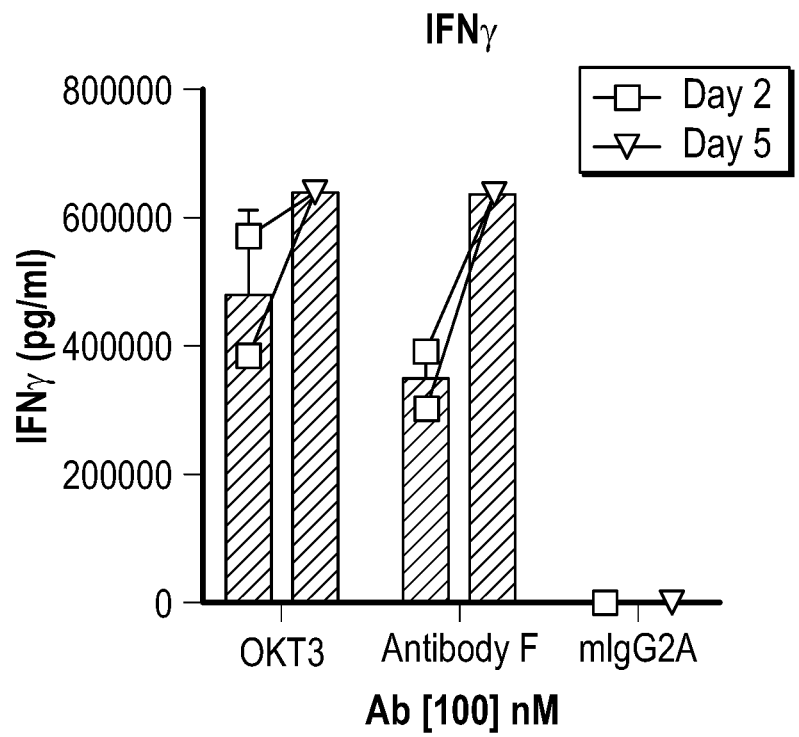
FIGS. 33A-33F are graphs showing cytokine secretion stimulated by anti-TRBC1 (Antibody F) or anti-CD3 (OKT3) at Days 2 and 5. Cytokines examined include: IFNγ, IL-2, IL-1β, IL-6, IL-10, and TNFα (FIGS. 33A-33F, respectively).
Figure 33B:
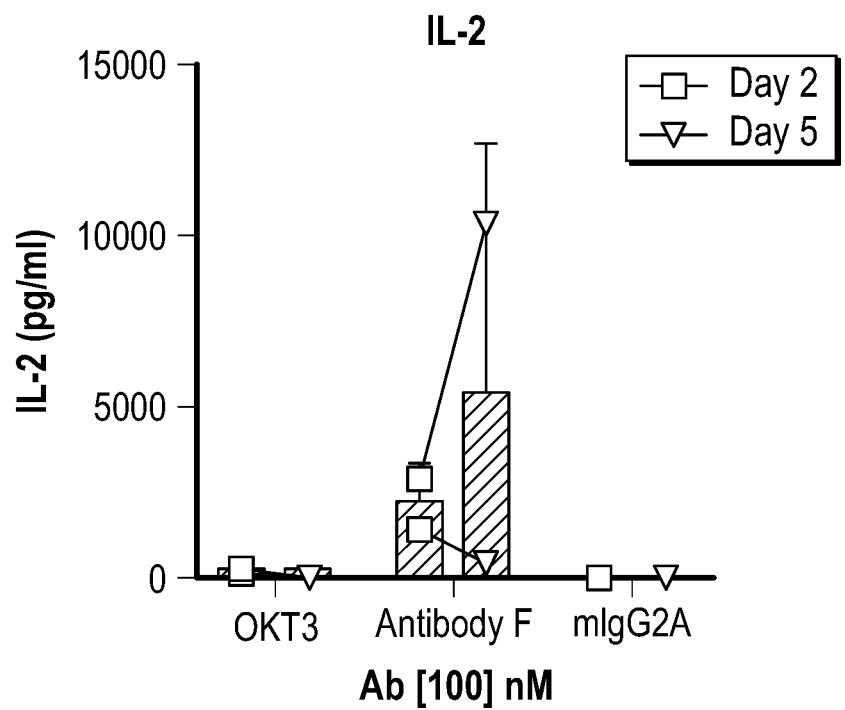
Figure 33C:
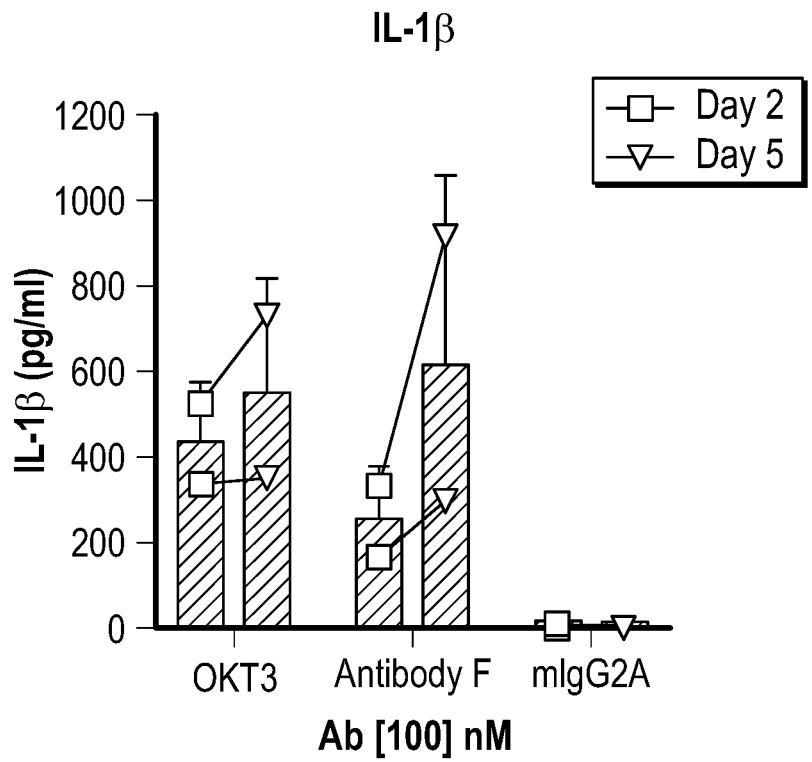
Figure 33D:
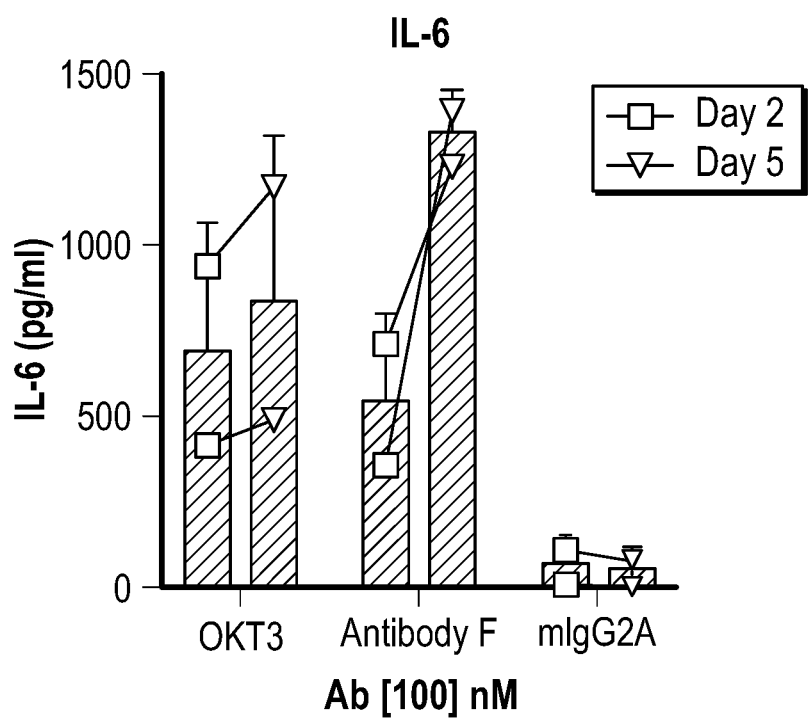
Figure 33E:
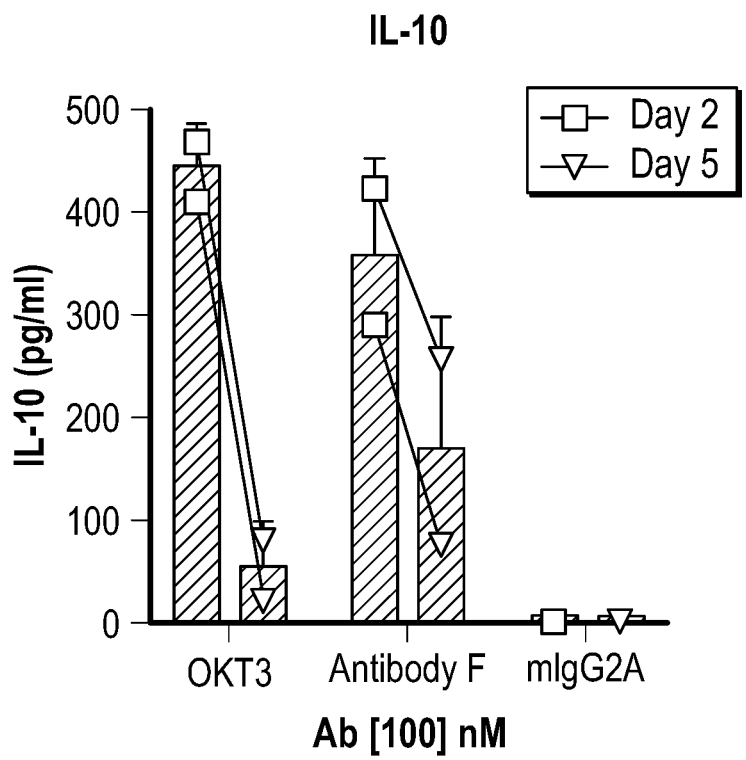
Figure 33F:
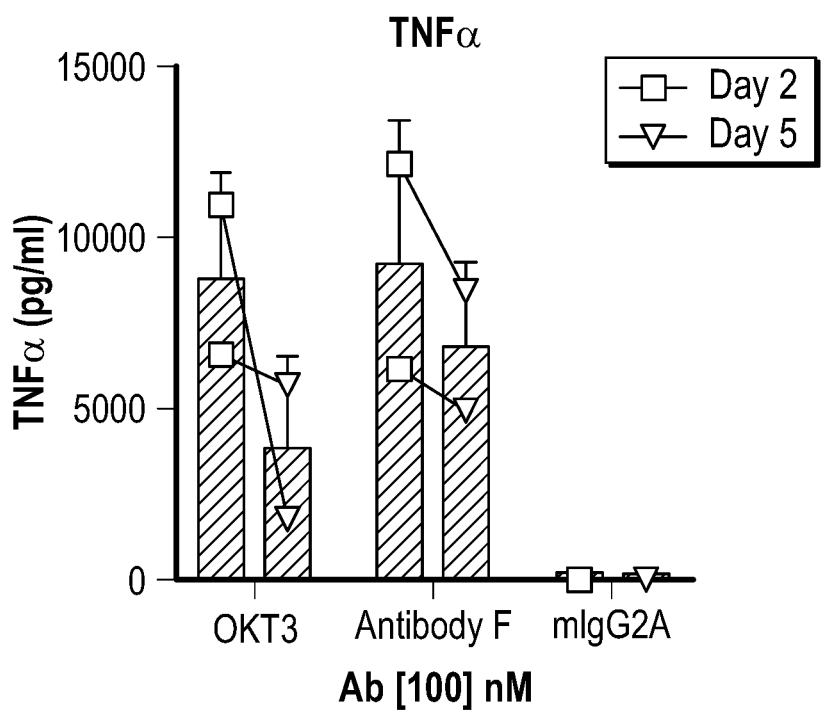

Human PBMCs were isolated from whole blood. From isolated PBMCs, human CD3+ T cells were isolated using magnetic-bead separation (negative selection) (Miltenyi biotec) and activated by immobilized (plate-coated) anti-TCR Vβ13.1 (A-H.1) at 100 nM for 6 days. Activated T-cells (from plate-coated) were then transferred and expanded in tissue culture flask in the presence of human IL-2 at a concentration of 50 U/ml for two additional days. Expanded TCR Vβ13.1+ cells were washed and co-cultured in the presence of BCMA-expressing RPMI8226 cells (target cells) at an E:T ratio of 5:1 and serial diluted concentrations of T-cell engager bispecific antibodies including, anti-TCR Vβ13.1BCMA (Molecule G), anti-CD3/BCMA, and anti-TCR Vβ13.1 (A-H.1, serving as control) for 24 hours. Post 24 hours, cell co-culture supernatants were collected and quantified for specific target cell death. Target cells (RPMI8226 cells) are a KILR-retroparticles reporter cell assay (DiscoverX). KILR-RPMI8226 target cells are engineered to stably express a protein tagged with enhanced ProLabel (ePL), a β-gal reporter fragment, using the KILR Retroparticles, and when the membrane of the target cells is compromised due to cell death, the target cells will release the tagged protein into the media. This KILR reporter protein was detected and percentage (%) of target cell death was calculated as described above. Data shown in FIG. 31B are mean values from 4 donors.

Example 21: Cytokine Profile of an Anti-TCRVb/BCMA Antibody Molecule

This Examples describes cytokines secreted by PBMCs following activation by the anti-TCR Vβ/anti-BCMA antibody Molecule H. For comparison, activation by an anti-TCR beta constant 1 (TRBC1) antibody Antibody F was also analyzed.

Briefly, human PBMCs were isolated from whole blood followed by solid-phase (plate-coated) stimulation with Molecule H or Antibody F at 100 nM. Supernatant was collected on Days 1, 2, 3, and 5 (for Molecule H) or Days 2 and 5 (for Antibody F) followed by multiplex cytokine analysis for IFNγ, IL-2, IL-10, IL-6, IL-10, and TNFα, quantified using MSD (Meso Scale Discovery) platform, following the manufacturer's protocol.

As shown in FIGS. 32A-32F and 33A-33F, the cytokine profile of the anti-TCR Vβ/anti-BCMA antibody Molecule H is different from that of the anti-CD3 antibody OKT3 or the anti-TRBC1 Antibody F.

INCORPORATION BY REFERENCE

All publications and patents mentioned herein are hereby incorporated by reference in their entirety as if each individual publication or patent was specifically and individually indicated to be incorporated by reference.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (3639 sequences)

SEQ ID NO: 1 - protein, 119 aa, Artificial Sequence
  source: /note="Description of Artificial Sequence: Synthetic polypeptide"
QVQLQQSGPELVKPGTSVKISCKASGYSFTTYYIHWVKQRPGQGLEWIGWFFPGSGNIKYNEKFKGKATLTADTSSSTAYMQLSSLTSEESAVYFCAGSYYSYDVLDYWGHGTTLTVSS

SEQ ID NO: 2 - protein, 107 aa, Artificial Sequence
  source: /note="Description of Artificial Sequence: Synthetic polypeptide"
DILMTQSQKFMSTSLGDRVSVSCKASQNVGINVVWHQQKPGQSPKALIYSSSHRYSGVPDRFTGSGSGTDFTLTINNVQSEDLAEYFCQQFKSYPLTFGAGTKLELK

SEQ ID NO: 3 - protein, 10 aa, Artificial Sequence
  source: /note="Description of Artificial Sequence: Synthetic peptide"
GYSFTTYYIH

SEQ ID NO: 4 - protein, 17 aa, Artificial Sequence
  source: /note="Description of Artificial Sequence: Synthetic peptide"
WFFPGSGNIKYNEKFKG

SEQ ID NO: 5 - protein, 10 aa, Artificial Sequence
  source: /note="Description of Artificial Sequence: Synthetic peptide"
SYYSYDVLDY

SEQ ID NO: 6 - protein, 11 aa, Artificial Sequence
  source: /note="Description of Artificial Sequence: Synthetic peptide"
KASQNVGINVV

SEQ ID NO: 7 - protein, 7 aa, Artificial Sequence
  source: /note="Description of Artificial Sequence: Synthetic peptide"
SSSHRYS

SEQ ID NO: 8 - protein, 9 aa, Artificial Sequence
  source: /note="Description of Artificial Sequence: Synthetic peptide"
QQFKSYPLT

SEQ ID NO: 9 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSS

SEQ ID NO: 10 - protein, 107 aa, Artificial Sequence
  source: /note="Description of Artificial Sequence: Synthetic polypeptide"
DIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 11 - protein, 107 aa, Artificial Sequence
  source: /note="Description of Artificial Sequence: Synthetic polypeptide"
DIQMTQSPSSLSASVGDRVTITCKASQNVGINVVWHQQKPGKVPKALIYSSSHRYSGVPSRFSGSGSGTDFTLTISSLQPEDVATYFCQQFKSYPLTFGQGTKLEIK

SEQ ID NO: 12 - DNA, 357 bp, Artificial Sequence
  source: /note="Description of Artificial Sequence: Synthetic polynucleotide"
caggtgcagctggttcagtctggcgccgaagtgaagaaacctggctcctccgtgaaggtgtcctgcaaggcttccggctactccttcaccacctactacatccactgggtccgacaggcccctggacaaggattggaatggatgggctggttcttccccggctccggcaacatcaagtacaacgagaagttcaagggccgcgtgaccatcaccgccgacacctctacctctaccgcctacatggaactgtccagcctgagatctgaggacaccgccgtgtactactgcgccggctcctactactcttacgacgtgctggattactggggccagggcaccacagtgacagtgtcctct

SEQ ID NO: 13 - DNA, 321 bp, Artificial Sequence
  source: /note="Description of Artificial Sequence: Synthetic polynucleotide"
gacatccagatgacccagtctccatccttcctgtccgcctctgtgggcgacagagtgaccatcacatgcaaggcctctcagaacgtgggcatcaacgtcgtgtggcaccagcagaagcctggcaaggctcctaaggctctgatctactcctccagccaccggtactctggcgtgccctctagattttccggctctggctctggcaccgagtttaccctgacaatctccagcctgcagcctgaggacttcgccacctacttttgccagcagttcaagagctaccctctgacctttggccagggcaccaagctggaaatcaag

SEQ ID NO: 14 - DNA, 321 bp, Artificial Sequence
  source: /note="Description of Artificial Sequence: Synthetic polynucleotide"
gacatccagatgacccagtctccatcctctctgtccgcctctgtgggcgacagagtgaccatcacatgcaaggcctctcagaacgtgggcatcaacgtcgtgtggcaccagcagaaacctggcaaggtgcccaaggctctgatctactcctccagccacagatactccggcgtgccctctagattctccggctctggctctggcaccgactttaccctgacaatctccagcctgcagcctgaggacgtggccacctacttttgccagcagttcaagagctaccctctgacctttggccagggcaccaagctggaaatcaag

SEQ ID NO: 15 - protein, 117 aa, Artificial Sequence
  source: /note="Description of Artificial Sequence: Synthetic polypeptide"
DVQLVESGGGLVQPGGSRKLSCAASGFTFSNFGMHWVRQAPDKGLEWVAYISSGSSTIYYADTLKGRFTISRDNPKNTLFLQMTSLRSEDTAMYYCARRGEGAMDYWGQGTSVTVSS

SEQ ID NO: 16 - protein, 106 aa, Artificial Sequence
  source: /note="Description of Artificial Sequence: Synthetic polypeptide"
ENVLTQSPAIMSASLGEKVTMSCRASSSVNYIYWYQQKSDASPKLWIYYTSNLAPGVPTRFSGSGSGNSYSLTISSMEGEDAATYYCQQFTSSPFTFGSGTKLEIK

SEQ ID NO: 17 - protein, 10 aa, Artificial Sequence
  source: /note="Description of Artificial Sequence: Synthetic peptide"
GFTFSNFGMH

SEQ ID NO: 18 - protein, 17 aa, Artificial Sequence
  source: /note="Description of Artificial Sequence: Synthetic peptide"
YISSGSSTIYYADTLKG

SEQ ID NO: 19 - protein, 8 aa, Artificial Sequence
  source: /note="Description of Artificial Sequence: Synthetic peptide"
RGEGAMDY

SEQ ID NO: 20 - protein, 10 aa, Artificial Sequence
  source: /note="Description of Artificial Sequence: Synthetic peptide"
RASSSVNYIY

SEQ ID NO: 21 - protein, 7 aa, Artificial Sequence
  source: /note="Description of Artificial Sequence: Synthetic peptide"
YTSNLAP

SEQ ID NO: 22 - protein, 9 aa, Artificial Sequence
  source: /note="Description of Artificial Sequence: Synthetic peptide"
QQFTSSPFT

SEQ ID NO: 23 - protein, 117 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAYISSGSSTIYYADTLKGRFTISRDNSKNTLYLQMNSLRAEDTAVYYCARRGEGAMDYWGQGTTVTVSS

SEQ ID NO: 24 - protein, 117 aa, Artificial Sequence
  source: /note="Description of Artificial Sequence: Synthetic polypeptide"
EVQLVESGGGLVQPGGSLRLSCAASGFTFSNFGMHWVRQAPGKGLEWVSYISSGSSTIYYADTLKGRFTISRDNSKNTLYLQMNSLRAEDTAVYYCARRGEGAMDYWGQGTTVTVSS

SEQ ID NO: 25 - protein, 117 aa, Artificial Sequence; identical to SEQ ID NO: 23
  source: /note="Description of Artificial Sequence: Synthetic polypeptide"

SEQ ID NO: 26 - protein, 106 aa, Artificial Sequence
  source: /note="Description of Artificial Sequence: Synthetic polypeptide"
DNQLTQSPSFLSASVGDRVTITCRASSSVNYIYWYQQKPGKAPKLLIYYTSNLAPGVPSRFSGSGSGNEYTLTISSLQPEDFATYYCQQFTSSPFTFGQGTKLEIK

SEQ ID NO: 27 - protein, 106 aa, Artificial Sequence
  source: /note="Description of Artificial Sequence: Synthetic polypeptide"
DNQLTQSPSSLSASVGDRVTITCRASSSVNYIYWYQQKPGKAPKLLIYYTSNLAPGVPSRFSGSGSGNDYTLTISSLQPEDFATYYCQQFTSSPFTFGQGTKLEIK

SEQ ID NO: 28 - protein, 106 aa, Artificial Sequence
  source: /note="Description of Artificial Sequence: Synthetic polypeptide"
ENVLTQSPATLSVSPGERATLSCRASSSVNYIYWYQQKPGQAPRLLIYYTSNLAPGIPARFSGSGSGNEYTLTISSLQSEDFAVYYCQQFTSSPFTFGQGTKLEIK

SEQ ID NO: 29 - protein, 105 aa, Artificial Sequence
  source: /note="Description of Artificial Sequence: Synthetic polypeptide"
QNVLTQPPSASGTPGQRVTISCRASSSVNYIYWYQQLPGTAPKLLIYYTSNLAPGVPDRFSGSGSGNSYSLAISGLRSEDEADYYCQQFTSSPFTFGTGTKVTVL

SEQ ID NO: 30 - protein, 105 aa, Artificial Sequence
  source: /note="Description of Artificial Sequence: Synthetic polypeptide"
SNELTQPPSVSVSPGQTARITCRASSSVNYIYWYQQKSGQAPVLVIYYTSNLAPGIPERFSGSGSGNMYTLTISGAQVEDEADYYCQQFTSSPFTFGTGTKVTVL

SEQ ID NO: 31 - DNA, 351 bp, Artificial Sequence
  source: /note="Description of Artificial Sequence: Synthetic polynucleotide"
gaggtgcagctggttgaatctggcggaggattggttcagcctggcggctctctgagactgtcttgtgccgcttctggcttcaccttctccaacttcggcatgcactgggtccgacaggcccctggaaaaggactggaatgggtgtcctacatctcctccggctcctccaccatctactacgctgacaccctgaagggcagattcaccatctctcgggacaacgccaagaactccctgtacctgcagatgaacagcctgagagccgaggacaccgccgtgtactactgtgctagaagaggcgagggcgccatggattattggggccagggaaccacagtgaccgtgtctagc

SEQ ID NO: 32 - DNA, 351 bp, Artificial Sequence
  source: /note="Description of Artificial Sequence: Synthetic polynucleotide"
gaggtgcagctggttgaatctggcggaggattggttcagcctggcggctctctgagactgtcttgtgccgcttctggcttcaccttctccaacttcggcatgcactgggtccgacaggcccctggaaaaggactggaatgggtgtcctacatctcctccggctcctccaccatctactacgctgacaccctgaagggcagattcaccatcagccgggacaactccaagaacaccctgtacctgcagatgaactccctgagagccgaggacaccgccgtgtactactgtgctagaagaggcgagggcgccatggattattggggccagggaaccacagtgaccgtgtctagc

SEQ ID NO: 33 - DNA, 351 bp, Artificial Sequence
  source: /note="Description of Artificial Sequence: Synthetic polynucleotide"
caggtgcagctggtggaatctggtggcggagttgtgcagcctggcagatccctgagactgtcttgtgccgcctctggcttcaccttctccaacttcggcatgcactgggtccgacaggcccctggaaaaggattggagtgggtcgcctacatctcctccggctcctccaccatctactacgctgacaccctgaagggcagattcaccatcagccgggacaactccaagaacaccctgtacctgcagatgaactccctgagagccgaggacaccgccgtgtactactgtgctagaagaggcgagggcgccatggattattggggccagggaaccacagtgaccgtgtctagc

SEQ ID NO: 34 - DNA, 318 bp, Artificial Sequence
  source: /note="Description of Artificial Sequence: Synthetic polynucleotide"
gataaccagctgacccagtctcctagcttcctgtctgcctctgtgggcgacagagtgacaattacctgccgggcctcctcctccgtgaactacatctactggtatcagcagaagcccggcaaggcccctaagctgctgatctactacacctccaatctggcccctggcgtgccctctagattttccggatctggctccggcaacgagtataccctgacaatctccagcctgcagcctgaggacttcgccacctactactgccagcagttcacctcctctccattcacctttggccagggcaccaagctggaaatcaaa

SEQ ID NO: 35 - DNA, 317 bp, Artificial Sequence
  source: /note="Description of Artificial Sequence: Synthetic polynucleotide"
ataaccagctgacccagtctccttccagcctgtctgcttctgtgggcgacagagtgacaattacctgccgggcctcctcctccgtgaactacatctactggtatcagcagaagcccggcaaggcccctaagctgctgatctactacacctccaatctggcccctggcgtgccctctagattttccggatctggctccggcaacgactataccctgacaatctccagcctgcagcctgaggacttcgccacctactactgccagcagttcacctcctctccattcacctttggccagggcaccaagctggaaatcaaa

SEQ ID NO: 36 - DNA, 318 bp, Artificial Sequence
  source: /note="Description of Artificial Sequence: Synthetic polynucleotide"
gagaatgtgctgacccagtctcctgccacactgtctgttagccctggcgagagagctaccctgagctgcagagcctcttcctccgtgaactacatctactggtatcagcagaagcccggccaggctcctagactgctgatctactacacctccaatctggcccctggcatccctgccagattttccggatctggctccggcaacgagtataccctgaccatctccagcctgcagtccgaggactttgctgtgtactattgccagcagttcacaagcagccctttcacctttggccagggcaccaagctggaaatcaaa

SEQ ID NO: 37 - DNA, 315 bp, Artificial Sequence
  source: /note="Description of Artificial Sequence: Synthetic polynucleotide"
cagaatgtgctgacccaacctccttccgcctctggcacacctggacagagagtgacaatctcctgccgggcctcctcctccgtgaactacatctactggtatcagcagctgcccggcaccgctcctaaactgctgatctactacacctccaatctggcccctggcgtgcccgatagattttccggatctggctccggcaactcctacagcctggctatctctggcctgagatctgaggacgaggccgactactactgccagcagttcacctcctctccattcacctttggcaccggcaccaaagtgacagttctt

SEQ ID NO: 38 - DNA, 315 bp, Artificial Sequence
  source: /note="Description of Artificial Sequence: Synthetic polynucleotide"
tctaatgagctgacccagcctccttccgtgtccgtgtctcctggacagaccgccagaattacctgccgggcctcctcctccgtgaactacatctactggtatcagcagaagtccggccaggctcctgtgctcgtgatctactacacctccaatctggcccctggcatccctgagagattctccggatctggctccggcaacatgtacaccctgaccatctctggcgcccaggtggaagatgaggccgactactactgccagcagttcacctcctctccattcacctttggcaccggcaccaaagtgacagttctt

SEQ ID NO: 39 - protein, 107 aa, Homo sapiens [sequence omitted]

SEQ ID NO: 40 - protein, 326 aa, Artificial Sequence
  source: /note="Description of Artificial Sequence: Synthetic polypeptide"
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 41 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - DNA, 344 bp, Artificial Sequence
  source: /note="Description of Artificial Sequence: Synthetic polynucleotide"
atgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactc

SEQ ID NO: 44 - protein, 114 aa, Artificial Sequence
  source: /note="Description of Artificial Sequence: Synthetic polypeptide"
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSY

SEQ ID NO: 45 - protein, 5 aa, Artificial Sequence
  source: /note="Description of Artificial Sequence: Synthetic peptide"
TYYIH

SEQ ID NO: 46 - protein, 17 aa, Artificial Sequence
  source: /note="Description of Artificial Sequence: Synthetic peptide"
WFFPGSGNIKYNEKFKG

SEQ ID NO: 47 - protein, 10 aa, Artificial Sequence
  source: /note="Description of Artificial Sequence: Synthetic peptide"
SYYSYDVLDY

SEQ ID NO: 48 - protein, 7 aa, Artificial Sequence
  source: /note="Description of Artificial Sequence: Synthetic peptide"
GYSFTTY

SEQ ID NO: 49 - protein, 6 aa, Artificial Sequence
  source: /note="Description of Artificial Sequence: Synthetic peptide"
FPGSGN

SEQ ID NO: 50 - protein, 10 aa, Artificial Sequence
  source: /note="Description of Artificial Sequence: Synthetic peptide"
SYYSYDVLDY

SEQ ID NO: 51 - protein, 11 aa, Artificial Sequence
  source: /note="Description of Artificial Sequence: Synthetic peptide"
KASQNVGINVV

SEQ ID NO: 52 - protein, 7 aa, Artificial Sequence
  source: /note="Description of Artificial Sequence: Synthetic peptide"
SSSHRYS

SEQ ID NO: 53 - protein, 9 aa, Artificial Sequence
  source: /note="Description of Artificial Sequence: Synthetic peptide"
QQFKSYPLT

SEQ ID NO: 54 - protein, 11 aa, Artificial Sequence
  source: /note="Description of Artificial Sequence: Synthetic peptide"
KASQNVGINVV

SEQ ID NO: 55 - protein, 7 aa, Artificial Sequence
  source: /note="Description of Artificial Sequence: Synthetic peptide"
SSSHRYS

SEQ ID NO: 56 - protein, 9 aa, Artificial Sequence
  source: /note="Description of Artificial Sequence: Synthetic peptide"
QQFKSYPLT

SEQ ID NO: 57 - protein, 5 aa, Artificial Sequence
  source: /note="Description of Artificial Sequence: Synthetic peptide"
NFGMH

SEQ ID NO: 58 - protein, 17 aa, Artificial Sequence
  source: /note="Description of Artificial Sequence: Synthetic peptide"
YISSGSSTIYYADTLKG

SEQ ID NO: 59 - protein, 8 aa, Artificial Sequence
  source: /note="Description of Artificial Sequence: Synthetic peptide"
RGEGAMDY

SEQ ID NO: 60 - protein, 7 aa, Artificial Sequence
  source: /note="Description of Artificial Sequence: Synthetic peptide"
GFTFSNF

SEQ ID NO: 61 - protein, 6 aa, Artificial Sequence
  source: /note="Description of Artificial Sequence: Synthetic peptide"
SSGSST

SEQ ID NO: 62 - protein, 8 aa, Artificial Sequence
  source: /note="Description of Artificial Sequence: Synthetic peptide"
RGEGAMDY

SEQ ID NO: 63 - protein, 10 aa, Artificial Sequence
  source: /note="Description of Artificial Sequence: Synthetic peptide"
RASSSVNYIY

SEQ ID NO: 64 - protein, 7 aa, Artificial Sequence
  source: /note="Description of Artificial Sequence: Synthetic peptide"
YTSNLAP

SEQ ID NO: 65 - protein, 9 aa, Artificial Sequence
  source: /note="Description of Artificial Sequence: Synthetic peptide"
QQFTSSPFT

SEQ ID NO: 66 - protein, 10 aa, Artificial Sequence
  source: /note="Description of Artificial Sequence: Synthetic peptide"
RASSSVNYIY

SEQ ID NO: 67 - protein, 7 aa, Artificial Sequence
  source: /note="Description of Artificial Sequence: Synthetic peptide"
YTSNLAP

SEQ ID NO: 68 - protein, 9 aa, Artificial Sequence
  source: /note="Description of Artificial Sequence: Synthetic peptide"
QQFTSSPFT

SEQ ID NO: 69 - protein, 592 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLASSLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 70 - protein, 492 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 71 - protein, 479 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSASPTSPKVFPLSLDSTPQDGNVVVACLVQGFFPQEPLSVTWSESGQNVTARNFPPSQDASGDLYTTSSQLTLPATQCPDGKSVTCHVKHYTNSSQDVTVPCRVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTYAVTSILRVAAEDWKKGETFSCMVGHEALPLAFTQKTIDRMAGKPTHINVSVVMAEADGTCY

SEQ ID NO: 72 - protein, 234 aa, Artificial Sequence
  source: /note="Description of Artificial Sequence: Synthetic polypeptide"
METDTLLLWVLLLWVPGSTGDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 453 aa, Artificial Sequence
  source: /note="Description of Artificial Sequence: Synthetic polypeptide"
GSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLASSLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 74 - protein, 353 aa, Artificial Sequence
  source: /note="Description of Artificial Sequence: Synthetic polypeptide"
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 75 - protein, 340 aa, Artificial Sequence
  source: /note="Description of Artificial Sequence: Synthetic polypeptide"
ASPTSPKVFPLSLDSTPQDGNVVVACLVQGFFPQEPLSVTWSESGQNVTARNFPPSQDASGDLYTTSSQLTLPATQCPDGKSVTCHVKHYTNSSQDVTVPCRVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTYAVTSILRVAAEDWKKGETFSCMVGHEALPLAFTQKTIDRMAGKPTHINVSVVMAEADGTCY

SEQ ID NO: 76 - protein, 159 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 77-79 - skipped (3 entries)

SEQ ID NO: 80 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRVSPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDRVAWYQQKPGKAPKALIYSSSHRYKGVPSRFSGSGSGTEFTLTISSLQPEDFATYFCQQFKSYPLTFGQGTKLEIK

SEQ ID NO: 81 - protein, 107 aa, Artificial Sequence
  source: /note="Description of Artificial Sequence: Synthetic polypeptide"
DIQMTQSPSFLSASVGDRVTITCKASQNVEDRVAWYQQKPGKAPKALIYSSSHRYKGVPSRFSGSGSGTEFTLTISSLQPEDFATYFCQQFKSYPLTFGQGTKLEIK

SEQ ID NO: 82 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRVSPGSGNTKYNEKFKGRVTITADTSTSTAYMELSSLRSEDTAVYYCAGSYYSYDVLDYWGQGTTVTVSS

SEQ ID NO: 83 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDRVAWYQQKPGKAPKALIYSSSHRYKGVPSRFSGSGSGTEFTLTISSLQPEDFATYFCQQFKSYPLTFGQGTKLEIK

SEQ ID NO: 84 - protein, 107 aa, Artificial Sequence; identical to SEQ ID NO: 81
  source: /note="Description of Artificial Sequence: Synthetic polypeptide"

SEQ ID NO: 85 - protein, 119 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNVKYNEKFKGRVTITADTSTSTAYMELSSLRSEDTAVYYCAGSYYSYDVLDYWGQGTTVTVSS

SEQ ID NO: 86 - protein, 246 aa, Artificial Sequence
  source: /note="Description of Artificial Sequence: Synthetic polypeptide"
QVQLVQSGAEVKKPGSSVKVSCKASGHDFRDFYIHWVRQAPGQGLEWMGRVYPGSGSYRYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 87 - protein, 107 aa, Artificial Sequence
  source: /note="Description of Artificial Sequence: Synthetic polypeptide"
DIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 88 - protein, 119 aa, Artificial Sequence
  source: /note="Description of Artificial Sequence: Synthetic polypeptide"
QVQLVQSGAEVKKPGSSVKVSCKASGHDFRDFYIHWVRQAPGQGLEWMGRVYPGSGSYRYNEKFKGRVTITADTSTSTAYMELSSLRSEDTAVYYCAGSYYSYDVLDYWGQGTTVTVSS

SEQ ID NO: 89 - protein, 246 aa, Artificial Sequence
  source: /note="Description of Artificial Sequence: Synthetic polypeptide"
QVQLVQSGAEVKKPGSSVKVSCKASGHDFKLTYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNRVAWYQQKPGKAPKALIYSSSHRYKGVPSRFSGSGSGTEFTLTISSLQPEDFATYFCQQFKSYPLTFGQGTKLEIK

SEQ ID NO: 90 - protein, 107 aa, Artificial Sequence
  source: /note="Description of Artificial Sequence: Synthetic polypeptide"
DIQMTQSPSFLSASVGDRVTITCKASQNVDNRVAWYQQKPGKAPKALIYSSSHRYKGVPSRFSGSGSGTEFTLTISSLQPEDFATYFCQQFKSYPLTFGQGTKLEIK

SEQ ID NO: 91 - protein, 119 aa, Artificial Sequence
  source: /note="Description of Artificial Sequence: Synthetic polypeptide"
QVQLVQSGAEVKKPGSSVKVSCKASGHDFKLTYIHWVRQAPGQGLEWMGRISAGSGNVKYNEKFKGRVTITADTSTSTAYMELSSLRSEDTAVYYCAGSYYSYDVLDYWGQGTTVTVSS

SEQ ID NO: 92 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRIFPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVENKVAWHQQKPGKAPKALIYSSSHRYKGVPSRFSGSGSGTEFTLTISSLQPEDFATYFCQQFKSYPLTFGQGTKLEIK

SEQ ID NO: 93 - protein, 107 aa, Artificial Sequence
  source: /note="Description of Artificial Sequence: Synthetic polypeptide"
DIQMTQSPSFLSASVGDRVTITCKASQNVENKVAWHQQKPGKAPKALIYSSSHRYKGVPSRFSGSGSGTEFTLTISSLQPEDFATYFCQQFKSYPLTFGQGTKLEIK

SEQ ID NO: 94 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRIFPGSGNVKYNEKFKGRVTITADTSTSTAYMELSSLRSEDTAVYYCAGSYYSYDVLDYWGQGTTVTVSS

SEQ ID NO: 95 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRIFAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 96 - protein, 107 aa, Artificial Sequence; identical to SEQ ID NO: 87
  source: /note="Description of Artificial Sequence: Synthetic polypeptide"

SEQ ID NO: 97 - protein, 119 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRIFAGSGNTKYNEKFKGRVTITADTSTSTAYMELSSLRSEDTAVYYCAGSYYSYDVLDYWGQGTTVTVSS

SEQ ID NO: 98 - protein, 246 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRVSAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGNRVAWYQQKPGKAPKALIYSSSHRYSGVPSRFSGSGSGTEFTLTISSLQPEDFATYFCQQFKSYPLTFGQGTKLEIK

SEQ ID NO: 99 - protein, 107 aa, Artificial Sequence
  source: /note="Description of Artificial Sequence: Synthetic polypeptide"
DIQMTQSPSFLSASVGDRVTITCKASQNVGNRVAWYQQKPGKAPKALIYSSSHRYSGVPSRFSGSGSGTEFTLTISSLQPEDFATYFCQQFKSYPLTFGQGTKLEIK

SEQ ID NO: 100 - protein, 119 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRVSAGSGNVKYNEKFKGRVTITADTSTSTAYMELSSLRSEDTAVYYCAGSYYSYDVLDYWGQGTTVTVSS

SEQ ID NO: 101 - protein, 247 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRIFAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVAWYQQKPGKAPKALIYSSSHRYKGVPSRFSGSGSGTEFTLTISSLQPEDFATYFCQQFKSYPLTFGQGTKLEIKS

SEQ ID NO: 102 - protein, 107 aa, Artificial Sequence
  source: /note="Description of Artificial Sequence: Synthetic polypeptide"
DIQMTQSPSFLSASVGDRVTITCKASQNVGDRVAWYQQKPGKAPKALIYSSSHRYKGVPSRFSGSGSGTEFTLTISSLQPEDFATYFCQQFKSYPLTFGQGTKLEIK

SEQ ID NO: 103 - protein, 119 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRIFAGSGNVKYNEKFKGRVTITADTSTSTAYMELSSLRSEDTAVYYCAGSYYSYDVLDYWGQGTTVTVSS

SEQ ID NO: 104 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRVSPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVAWYQQKPGKAPKALIYSSSHRYKGVPSRFSGSGSGTEFTLTISSLQPEDFATYFCQQFKSYPLTFGQGTKLEIK

SEQ ID NO: 105 - protein, 107 aa, Artificial Sequence; identical to SEQ ID NO: 102
  source: /note="Description of Artificial Sequence: Synthetic polypeptide"

SEQ ID NO: 106 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRVSPGSGNVKYNEKFKGRVTITADTSTSTAYMELSSLRSEDTAVYYCAGSYYSYDVLDYWGQGTTVTVSS

SEQ ID NO: 107 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRVSAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGNRVAWYQQKPGKAPKALIYSSSHRYKGVPSRFSGSGSGTEFTLTISSLQPEDFATYFCQQFKSYPLTFGQGTKLEIK

SEQ ID NO: 108 - protein, 107 aa, Artificial Sequence
  source: /note="Description of Artificial Sequence: Synthetic polypeptide"
DIQMTQSPSFLSASVGDRVTITCKASQNVGNRVAWYQQKPGKAPKALIYSSSHRYKGVPSRFSGSGSGTEFTLTISSLQPEDFATYFCQQFKSYPLTFGQGTKLEIK

SEQ ID NO: 109 - protein, 119 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRVSAGSGNTKYNEKFKGRVTITADTSTSTAYMELSSLRSEDTAVYYCAGSYYSYDVLDYWGQGTTVTVSS

SEQ ID NO: 110 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRIFPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNRVAWYQQKPGKAPKALIYSSSHRYKGVPSRFSGSGSGTEFTLTISSLQPEDFATYFCQQFKSYPLTFGQGTKLEIK

SEQ ID NO: 111 - protein, 107 aa, Artificial Sequence; identical to SEQ ID NO: 90
  source: /note="Description of Artificial Sequence: Synthetic polypeptide"

SEQ ID NO: 112 - protein, 119 aa, Artificial Sequence; identical to SEQ ID NO: 94
  source: /note="Description of Artificial Sequence: Synthetic polypeptide"

SEQ ID NO: 113 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 114 - protein, 107 aa, Artificial Sequence; identical to SEQ ID NO: 87
  source: /note="Description of Artificial Sequence: Synthetic polypeptide"

SEQ ID NO: 115 - protein, 119 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNTKYNEKFKGRVTITADTSTSTAYMELSSLRSEDTAVYYCAGSYYSYDVLDYWGQGTTVTVSS

SEQ ID NO: 116 - protein, 246 aa, Artificial Sequence
  source: /note="Description of Artificial Sequence: Synthetic polypeptide"
QVQLVQSGAEVKKPGSSVKVSCKASGTDFRLTYIHWVRQAPGQGLEWMGRVSPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNKVAWHQQKPGKAPKALIYSSSHRYKGVPSRFSGSGSGTEFTLTISSLQPEDFATYFCQQFKSYPLTFGQGTKLEIK

SEQ ID NO: 117 - protein, 107 aa, Artificial Sequence
  source: /note="Description of Artificial Sequence: Synthetic polypeptide"
DIQMTQSPSFLSASVGDRVTITCKASQNVDNKVAWHQQKPGKAPKALIYSSSHRYKGVPSRFSGSGSGTEFTLTISSLQPEDFATYFCQQFKSYPLTFGQGTKLEIK

SEQ ID NO: 118 - protein, 119 aa, Artificial Sequence
  source: /note="Description of Artificial Sequence: Synthetic polypeptide"
QVQLVQSGAEVKKPGSSVKVSCKASGTDFRLTYIHWVRQAPGQGLEWMGRVSPGSGNTKYNEKFKGRVTITADTSTSTAYMELSSLRSEDTAVYYCAGSYYSYDVLDYWGQGTTVTVSS

SEQ ID NO: 119 - protein, 246 aa, Artificial Sequence
  source: /note="Description of Artificial Sequence: Synthetic polypeptide"
QVQLVQSGAEVKKPGSSVKVSCKASGGTFRLTYIHWVRQAPGQGLEWMGRVYPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 120 - protein, 107 aa, Artificial Sequence; identical to SEQ ID NO: 87
  source: /note="Description of Artificial Sequence: Synthetic polypeptide"

SEQ ID NO: 121 - protein, 119 aa, Artificial Sequence
  source: /note="Description of Artificial Sequence: Synthetic polypeptide"
QVQLVQSGAEVKKPGSSVKVSCKASGGTFRLTYIHWVRQAPGQGLEWMGRVYPGSGNTKYNEKFKGRVTITADTSTSTAYMELSSLRSEDTAVYYCAGSYYSYDVLDYWGQGTTVTVSS

SEQ ID NO: 122 - protein, 246 aa, Artificial Sequence
  source: /note="Description of Artificial Sequence: Synthetic polypeptide"
QVQLVQSGAEVKKPGSSVKVSCKASGTDFRLTYIHWVRQAPGQGLEWMGRIFPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 123 - protein, 107 aa, Artificial Sequence; identical to SEQ ID NO: 87
  source: /note="Description of Artificial Sequence: Synthetic polypeptide"

SEQ ID NO: 124 - protein, 119 aa, Artificial Sequence
  source: /note="Description of Artificial Sequence: Synthetic polypeptide"
QVQLVQSGAEVKKPGSSVKVSCKASGTDFRLTYIHWVRQAPGQGLEWMGRIFPGSGNTKYNEKFKGRVTITADTSTSTAYMELSSLRSEDTAVYYCAGSYYSYDVLDYWGQGTTVTVSS

SEQ ID NO: 125 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRIFPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDRVAWYQQKPGKAPKALIYSSSHRYKGVPSRFSGSGSGTEFTLTISSLQPEDFATYFCQQFKSYPLTFGQGTKLEIK

SEQ ID NO: 126 - protein, 107 aa, Artificial Sequence; identical to SEQ ID NO: 81
  source: /note="Description of Artificial Sequence: Synthetic polypeptide"

SEQ ID NO: 127 - protein, 119 aa, Artificial Sequence; identical to SEQ ID NO: 94
  source: /note="Description of Artificial Sequence: Synthetic polypeptide"

SEQ ID NO: 128 - protein, 246 aa, Artificial Sequence
  source: /note="Description of Artificial Sequence: Synthetic polypeptide"
QVQLVQSGAEVKKPGSSVKVSCKASGGTFRLTYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVAWYQQKPGKAPKALIYSSSHRYKGVPSRFSGSGSGTEFTLTISSLQPEDFATYFCQQFKSYPLTFGQGTKLEIK

SEQ ID NO: 129 - protein, 107 aa, Artificial Sequence; identical to SEQ ID NO: 102
  source: /note="Description of Artificial Sequence: Synthetic polypeptide"

SEQ ID NO: 130 - protein, 119 aa, Artificial Sequence
  source: /note="Description of Artificial Sequence: Synthetic polypeptide"
QVQLVQSGAEVKKPGSSVKVSCKASGGTFRLTYIHWVRQAPGQGLEWMGRISAGSGNVKYNEKFKGRVTITADTSTSTAYMELSSLRSEDTAVYYCAGSYYSYDVLDYWGQGTTVTVSS

SEQ ID NO: 131 - protein, 246 aa, Artificial Sequence
  source: /note="Description of Artificial Sequence: Synthetic polypeptide"
QVQLVQSGAEVKKPGSSVKVSCKASGGTFDKTYIHWVRQAPGQGLEWMGRISAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 132 - protein, 107 aa, Artificial Sequence; identical to SEQ ID NO: 87
  source: /note="Description of Artificial Sequence: Synthetic polypeptide"

SEQ ID NO: 133 - protein, 119 aa, Artificial Sequence
  source: /note="Description of Artificial Sequence: Synthetic polypeptide"
QVQLVQSGAEVKKPGSSVKVSCKASGGTFDKTYIHWVRQAPGQGLEWMGRISAGSGNTKYNEKFKGRVTITADTSTSTAYMELSSLRSEDTAVYYCAGSYYSYDVLDYWGQGTTVTVSS

SEQ ID NO: 134 - protein, 246 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRISAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 135 - protein, 107 aa, Artificial Sequence; identical to SEQ ID NO: 87
  source: /note="Description of Artificial Sequence: Synthetic polypeptide"

SEQ ID NO: 136 - protein, 119 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRISAGSGNTKYNEKFKGRVTITADTSTSTAYMELSSLRSEDTAVYYCAGSYYSYDVLDYWGQGTTVTVSS

SEQ ID NO: 137 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNKVAWHQQKPGKAPKALIYSSSHRYKGVPSRFSGSGSGTEFTLTISSLQPEDFATYFCQQFKSYPLTFGQGTKLEIK

SEQ ID NO: 138 - protein, 107 aa, Artificial Sequence; identical to SEQ ID NO: 117
  source: /note="Description of Artificial Sequence: Synthetic polypeptide"

SEQ ID NO: 139 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISAGSGNVKYNEKFKGRVTITADTSTSTAYMELSSLRSEDTAVYYCAGSYYSYDVLDYWGQGTTVTVSS

SEQ ID NO: 140 - protein, 246 aa, Artificial Sequence
  source: /note="Description of Artificial Sequence: Synthetic polypeptide"
QVQLVQSGAEVKKPGSSVKVSCKASGHDFRLTYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVADRVAWYQQKPGKAPKALIYSSSHRYKGVPSRFSGSGSGTEFTLTISSLQPEDFATYFCQQFKSYPLTFGQGTKLEIK

SEQ ID NO: 141 - protein, 107 aa, Artificial Sequence
  source: /note="Description of Artificial Sequence: Synthetic polypeptide"
DIQMTQSPSFLSASVGDRVTITCKASQNVADRVAWYQQKPGKAPKALIYSSSHRYKGVPSRFSGSGSGTEFTLTISSLQPEDFATYFCQQFKSYPLTFGQGTKLEIK

SEQ ID NO: 142 - protein, 119 aa, Artificial Sequence
  source: /note="Description of Artificial Sequence: Synthetic polypeptide"
QVQLVQSGAEVKKPGSSVKVSCKASGHDFRLTYIHWVRQAPGQGLEWMGRISAGSGNVKYNEKFKGRVTITADTSTSTAYMELSSLRSEDTAVYYCAGSYYSYDVLDYWGQGTTVTVSS

SEQ ID NO: 143 - protein, 246 aa, Artificial Sequence
  source: /note="Description of Artificial Sequence: Synthetic polypeptide"
QVQLVQSGAEVKKPGSSVKVSCKASGHDFHLWYIHWVRQAPGQGLEWMGRVSAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNKVAWHQQKPGKAPKALIYSSSHRYKGVPSRFSGSGSGTEFTLTISSLQPEDFATYFCQQFKSYPLTFGQGTKLEIK

SEQ ID NO: 144 - protein, 107 aa, Artificial Sequence; identical to SEQ ID NO: 117
  source: /note="Description of Artificial Sequence: Synthetic polypeptide"

SEQ ID NO: 145 - protein, 119 aa, Artificial Sequence
  source: /note="Description of Artificial Sequence: Synthetic polypeptide"
QVQLVQSGAEVKKPGSSVKVSCKASGHDFHLWYIHWVRQAPGQGLEWMGRVSAGSGNVKYNEKFKGRVTITADTSTSTAYMELSSLRSEDTAVYYCAGSYYSYDVLDYWGQGTTVTVSS

SEQ ID NO: 146 - protein, 246 aa, Artificial Sequence
  source: /note="Description of Artificial Sequence: Synthetic polypeptide"
QVQLVQSGAEVKKPGSSVKVSCKASGHDFHLWYIHWVRQAPGQGLEWMGRVFAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDKVAWYQQKPGKAPKALIYSSSHRYKGVPSRFSGSGSGTEFTLTISSLQPEDFATYFCQQFKSYPLTFGQGTKLEIK

SEQ ID NO: 147 - protein, 107 aa, Artificial Sequence
  source: /note="Description of Artificial Sequence: Synthetic polypeptide"
DIQMTQSPSFLSASVGDRVTITCKASQNVEDKVAWYQQKPGKAPKALIYSSSHRYKGVPSRFSGSGSGTEFTLTISSLQPEDFATYFCQQFKSYPLTFGQGTKLEIK

SEQ ID NO: 148 - protein, 119 aa, Artificial Sequence
  source: /note="Description of Artificial Sequence: Synthetic polypeptide"
QVQLVQSGAEVKKPGSSVKVSCKASGHDFHLWYIHWVRQAPGQGLEWMGRVFAGSGNTKYNEKFKGRVTITADTSTSTAYMELSSLRSEDTAVYYCAGSYYSYDVLDYWGQGTTVTVSS

SEQ ID NO: 149 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRIFPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 150 - protein, 107 aa, Artificial Sequence; identical to SEQ ID NO: 87
  source: /note="Description of Artificial Sequence: Synthetic polypeptide"

SEQ ID NO: 151 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRIFPGSGNTKYNEKFKGRVTITADTSTSTAYMELSSLRSEDTAVYYCAGSYYSYDVLDYWGQGTTVTVSS

SEQ ID NO: 152 - skipped

SEQ ID NO: 153 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRVSAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGNRVAWYQQKPGKAPKALIYSSSHRYKGVPSRFSGSGSGTEFTLTISSLQPEDFATYFCQQFKSYPLTFGQGTKLEIK

SEQ ID NO: 154 - protein, 107 aa, Artificial Sequence; identical to SEQ ID NO: 108
  source: /note="Description of Artificial Sequence: Synthetic polypeptide"

SEQ ID NO: 155 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRVSAGSGNVKYNEKFKGRVTITADTSTSTAYMELSSLRSEDTAVYYCAGSYYSYDVLDYWGQGTTVTVSS

SEQ ID NO: 156 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVAWYQQKPGKAPKALIYSSSHRYKGVPSRFSGSGSGTEFTLTISSLQPEDFATYFCQQFKSYPLTFGQGTKLEIK

SEQ ID NO: 157 - protein, 107 aa, Artificial Sequence; identical to SEQ ID NO: 102
  source: /note="Description of Artificial Sequence: Synthetic polypeptide"

SEQ ID NO: 158 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISPGSGNTKYNEKFKGRVTITADTSTSTAYMELSSLRSEDTAVYYCAGSYYSYDVLDYWGQGTTVTVSS

SEQ ID NO: 159 - protein, 246 aa, Artificial Sequence
  source: /note="Description of Artificial Sequence: Synthetic polypeptide"
QVQLVQSGAEVKKPGSSVKVSCKASGHDFHLWYIHWVRQAPGQGLEWMGRISPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVAWHQQKPGKAPKALIYSSSHRYKGVPSRFSGSGSGTEFTLTISSLQPEDFATYFCQQFKSYPLTFGQGTKLEIK

SEQ ID NO: 160 - protein, 107 aa, Artificial Sequence
  source: /note="Description of Artificial Sequence: Synthetic polypeptide"
DIQMTQSPSFLSASVGDRVTITCKASQNVGDRVAWHQQKPGKAPKALIYSSSHRYKGVPSRFSGSGSGTEFTLTISSLQPEDFATYFCQQFKSYPLTFGQGTKLEIK

SEQ ID NO: 161 - protein, 119 aa, Artificial Sequence
  source: /note="Description of Artificial Sequence: Synthetic polypeptide"
QVQLVQSGAEVKKPGSSVKVSCKASGHDFHLWYIHWVRQAPGQGLEWMGRISPGSGNVKYNEKFKGRVTITADTSTSTAYMELSSLRSEDTAVYYCAGSYYSYDVLDYWGQGTTVTVSS

SEQ ID NO: 162 - protein, 246 aa, Artificial Sequence
  source: /note="Description of Artificial Sequence: Synthetic polypeptide"
QVQLVQSGAEVKKPGSSVKVSCKASGHDFKLTYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 163 - protein, 107 aa, Artificial Sequence; identical to SEQ ID NO: 87
  source: /note="Description of Artificial Sequence: Synthetic polypeptide"

SEQ ID NO: 164 - protein, 119 aa, Artificial Sequence; identical to SEQ ID NO: 91
  source: /note="Description of Artificial Sequence: Synthetic polypeptide"

SEQ ID NO: 165 - protein, 246 aa, Artificial Sequence
  source: /note="Description of Artificial Sequence: Synthetic polypeptide"
QVQLVQSGAEVKKPGSSVKVSCKASGTDFHLWYIHWVRQAPGQGLEWMGRVFAGSGSYRYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 166 - protein, 107 aa, Artificial Sequence; identical to SEQ ID NO: 87
  source: /note="Description of Artificial Sequence: Synthetic polypeptide"

SEQ ID NO: 167 - protein, 119 aa, Artificial Sequence
  source: /note="Description of Artificial Sequence: Synthetic polypeptide"
QVQLVQSGAEVKKPGSSVKVSCKASGTDFHLWYIHWVRQAPGQGLEWMGRVFAGSGSYRYNEKFKGRVTITADTSTSTAYMELSSLRSEDTAVYYCAGSYYSYDVLDYWGQGTTVTVSS

SEQ ID NO: 168 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVADRVAWYQQKPGKAPKALIYSSSHRYKGVPSRFSGSGSGTEFTLTISSLQPEDFATYFCQQFKSYPLTFGQGTKLEIK

SEQ ID NO: 169 - protein, 107 aa, Artificial Sequence; identical to SEQ ID NO: 141
  source: /note="Description of Artificial Sequence: Synthetic polypeptide"

SEQ ID NO: 170 - protein, 119 aa, Artificial Sequence; identical to SEQ ID NO: 115
  source: /note="Description of Artificial Sequence: Synthetic polypeptide"

SEQ ID NO: 171 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDRVAWYQQKPGKAPKALIYSSSHRYKGVPSRFSGSGSGTEFTLTISSLQPEDFATYFCQQFKSYPLTFGQGTKLEIK

SEQ ID NO: 172 - protein, 107 aa, Artificial Sequence; identical to SEQ ID NO: 81
  source: /note="Description of Artificial Sequence: Synthetic polypeptide"

SEQ ID NO: 173 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISAGSGNTKYNEKFKGRVTITADTSTSTAYMELSSLRSEDTAVYYCAGSYYSYDVLDYWGQGTTVTVSS

SEQ ID NO: 174 - protein, 246 aa, Artificial Sequence
  source: /note="Description of Artificial Sequence: Synthetic polypeptide"
QVQLVQSGAEVKKPGSSVKVSCKASGTDFRLTYIHWVRQAPGQGLEWMGRISPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGNRVAWYQQKPGKAPKALIYSSSHRYKGVPSRFSGSGSGTEFTLTISSLQPEDFATYFCQQFKSYPLTFGQGTKLEIK

SEQ ID NO: 175 - protein, 107 aa, Artificial Sequence; identical to SEQ ID NO: 108
  source: /note="Description of Artificial Sequence: Synthetic polypeptide"

SEQ ID NO: 176 - protein, 119 aa, Artificial Sequence
  source: /note="Description of Artificial Sequence: Synthetic polypeptide"
QVQLVQSGAEVKKPGSSVKVSCKASGTDFRLTYIHWVRQAPGQGLEWMGRISPGSGNTKYNEKFKGRVTITADTSTSTAYMELSSLRSEDTAVYYCAGSYYSYDVLDYWGQGTTVTVSS

SEQ ID NO: 177 - protein, 246 aa, Artificial Sequence
  source: /note="Description of Artificial Sequence: Synthetic polypeptide"
QVQLVQSGAEVKKPGSSVKVSCKASGHDFDKTYIHWVRQAPGQGLEWMGRVSAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDRVAWYQQKPGKAPKALIYSSSHRYKGVPSRFSGSGSGTEFTLTISSLQPEDFATYFCQQFKSYPLTFGQGTKLEIK

SEQ ID NO: 178 - protein, 107 aa, Artificial Sequence; identical to SEQ ID NO: 81
  source: /note="Description of Artificial Sequence: Synthetic polypeptide"

SEQ ID NO: 179 - protein, 119 aa, Artificial Sequence
  source: /note="Description of Artificial Sequence: Synthetic polypeptide"
QVQLVQSGAEVKKPGSSVKVSCKASGHDFDKTYIHWVRQAPGQGLEWMGRVSAGSGNVKYNEKFKGRVTITADTSTSTAYMELSSLRSEDTAVYYCAGSYYSYDVLDYWGQGTTVTVSS

SEQ ID NO: 180 - protein, 246 aa, Artificial Sequence
  source: /note="Description of Artificial Sequence: Synthetic polypeptide"
QVQLVQSGAEVKKPGSSVKVSCKASGHDFKLTYIHWVRQAPGQGLEWMGRVSPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVEDRVAWHQQKPGKAPKALIYSSSHRYKGVPSRFSGSGSGTEFTLTISSLQPEDFATYFCQQFKSYPLTFGQGTKLEIK

SEQ ID NO: 181 - protein, 107 aa, Artificial Sequence
  source: /note="Description of Artificial Sequence: Synthetic polypeptide"
DIQMTQSPSFLSASVGDRVTITCKASQNVEDRVAWHQQKPGKAPKALIYSSSHRYKGVPSRFSGSGSGTEFTLTISSLQPEDFATYFCQQFKSYPLTFGQGTKLEIK

SEQ ID NO: 182 - protein, 119 aa, Artificial Sequence
  source: /note="Description of Artificial Sequence: Synthetic polypeptide"
QVQLVQSGAEVKKPGSSVKVSCKASGHDFKLTYIHWVRQAPGQGLEWMGRVSPGSGNTKYNEKFKGRVTITADTSTSTAYMELSSLRSEDTAVYYCAGSYYSYDVLDYWGQGTTVTVSS

SEQ ID NO: 183 - protein, 246 aa, Artificial Sequence
  source: /note="Description of Artificial Sequence: Synthetic polypeptide"
QVQLVQSGAEVKKPGSSVKVSCKASGHDFDKTYIHWVRQAPGQGLEWMGRIYPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVADRVAWYQQKPGKAPKALIYSSSHRYKGVPSRFSGSGSGTEFTLTISSLQPEDFATYFCQQFKSYPLTFGQGTKLEIK

SEQ ID NO: 184 - protein, 107 aa, Artificial Sequence; identical to SEQ ID NO: 141
  source: /note="Description of Artificial Sequence: Synthetic polypeptide"

SEQ ID NO: 185 - protein, 119 aa, Artificial Sequence
  source: /note="Description of Artificial Sequence: Synthetic polypeptide"
QVQLVQSGAEVKKPGSSVKVSCKASGHDFDKTYIHWVRQAPGQGLEWMGRIYPGSGNVKYNEKFKGRVTITADTSTSTAYMELSSLRSEDTAVYYCAGSYYSYDVLDYWGQGTTVTVSS

SEQ ID NO: 186 - protein, 246 aa, Artificial Sequence
  source: /note="Description of Artificial Sequence: Synthetic polypeptide"
QVQLVQSGAEVKKPGSSVKVSCKASGTDFDKTYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 187 - protein, 107 aa, Artificial Sequence; identical to SEQ ID NO: 87
  source: /note="Description of Artificial Sequence: Synthetic polypeptide"

SEQ ID NO: 188 - protein, 119 aa, Artificial Sequence
  source: /note="Description of Artificial Sequence: Synthetic polypeptide"
QVQLVQSGAEVKKPGSSVKVSCKASGTDFDKTYIHWVRQAPGQGLEWMGRISAGSGNVKYNEKFKGRVTITADTSTSTAYMELSSLRSEDTAVYYCAGSYYSYDVLDYWGQGTTVTVSS

SEQ ID NO: 189 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 190 - protein, 107 aa, Artificial Sequence; identical to SEQ ID NO: 87
  source: /note="Description of Artificial Sequence: Synthetic polypeptide"

SEQ ID NO: 191 - protein, 119 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNIKYNEKFKGRVTITADTSTSTAYMELSSLRSEDTAVYYCAGSYYSYDVLDYWGQGTTVTVSS

SEQ ID NO: 192 - protein, 246 aa, Artificial Sequence
  source: /note="Description of Artificial Sequence: Synthetic polypeptide"
QVQLVQSGAEVKKPGSSVKVSCKASGTDFDKIYIHWVRQAPGQGLEWMGRISAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVAWYQQKPGKAPKALIYSSSHRYKGVPSRFSGSGSGTEFTLTISSLQPEDFATYFCQQFKSYPLTFGQGTKLEIK

SEQ ID NO: 193 - protein, 107 aa, Artificial Sequence; identical to SEQ ID NO: 102
  source: /note="Description of Artificial Sequence: Synthetic polypeptide"

SEQ ID NO: 194 - protein, 119 aa, Artificial Sequence; identical to SEQ ID NO: 85
  source: /note="Description of Artificial Sequence: Synthetic polypeptide"

SEQ ID NO: 195 - protein, 246 aa, Artificial Sequence
  source: /note="Description of Artificial Sequence: Synthetic polypeptide"
QVQLVQSGAEVKKPGSSVKVSCKASGGTFKLTYIHWVRQAPGQGLEWMGRVSAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDDRVAWYQQKPGKAPKALIYSSSHRYKGVPSRFSGSGSGTEFTLTISSLQPEDFATYFCQQFKSYPLTFGQGTKLEIK

SEQ ID NO: 196 - protein, 107 aa, Artificial Sequence; identical to SEQ ID NO: 87
  source: /note="Description of Artificial Sequence: Synthetic polypeptide"

SEQ ID NO: 197 - protein, 119 aa, Artificial Sequence
  source: /note="Description of Artificial Sequence: Synthetic polypeptide"
QVQLVQSGAEVKKPGSSVKVSCKASGGTFKLTYIHWVRQAPGQGLEWMGRVSAGSGNVKYNEKFKGRVTITADTSTSTAYMELSSLRSEDTAVYYCAGSYYSYDVLDYWGQGTTVTVSS

SEQ ID NO: 198 - protein, 246 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISPGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNRVAWHQQKPGKAPKALIYSSSHRYKGVPSRFSGSGSGTEFTLTISSLQPEDFATYFCQQFKSYPLTFGQGTKLEIK

SEQ ID NO: 199 - protein, 107 aa, Artificial Sequence
  source: /note="Description of Artificial Sequence: Synthetic polypeptide"
DIQMTQSPSFLSASVGDRVTITCKASQNVDNRVAWHQQKPGKAPKALIYSSSHRYKGVPSRFSGSGSGTEFTLTISSLQPEDFATYFCQQFKSYPLTFGQGTKLEIK

SEQ ID NO: 200 - protein, 119 aa, Artificial Sequence
  source: /note="Description of Artificial Sequence: Synthetic polypeptide"
QVQLVQSGAEVKKPGSSVKVSCKASGTDFKLTYIHWVRQAPGQGLEWMGRISPGSGNVKYNEKFKGRVTITADTSTSTAYMELSSLRSEDTAVYYCAGSYYSYDVLDYWGQGTTVTVSS

SEQ ID NO: 201 - protein, 246 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRVSAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVDNRVAWYQQKPGKAPKALIYSSSHRYKGVPSRFSGSGSGTEFTLTISSLQPEDFATYFCQQFKSYPLTFGQGTKLEIK

SEQ ID NO: 202 - protein, 107 aa, Artificial Sequence; identical to SEQ ID NO: 90
  source: /note="Description of Artificial Sequence: Synthetic polypeptide"

SEQ ID NO: 203 - protein, 119 aa, Artificial Sequence
  source: /note="Description of Artificial Sequence: Synthetic polypeptide"
QVQLVQSGAEVKKPGSSVKVSCKASGHDFDKFYIHWVRQAPGQGLEWMGRVSAGSGNTKYNEKFKGRVTITADTSTSTAYMELSSLRSEDTAVYYCAGSYYSYDVLDYWGQGTTVTVSS

SEQ ID NO: 204 - protein, 246 aa, Artificial Sequence
  source: /note="Description of Artificial Sequence: Synthetic polypeptide"
QVQLVQSGAEVKKPGSSVKVSCKASGTDFDKFYIHWVRQAPGQGLEWMGRVSAGSGNVKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGDRVVWYQQKPGKAPKALIYSSSHRYKGVPSRFSGSGSGTEFTLTISSLQPEDFATYFCQQFKSYPLTFGQGTKLEIK

SEQ ID NO: 205 - protein, 119 aa, Artificial Sequence
  source: /note="Description of Artificial Sequence: Synthetic polypeptide"
QVQLVQSGAEVKKPGSSVKVSCKASGTDFDKFYIHWVRQAPGQGLEWMGRVSAGSGNVKYNEKFKGRVTITADTSTSTAYMELSSLRSEDTAVYYCAGSYYSYDVLDYWGQGTTVTVSS

SEQ ID NO: 206 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSAGSGNTKYNEKFKGRVTITADTSTSTAYMELSSLRSEDTAVYYCAVSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 207 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSAGSGNTKYNEKFKGRVTITADTSTSTAYMELSSLRSEDTAVYYCAVSYYSYDVLDYWGQGTTVTVSS

SEQ ID NO: 208 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSAGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 209 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSAGSGNTKYNEKFKGRVTITADTSTSTAYMELSSLRSEDTAVYYCAGSYYSYDVLDYWGQGTTVTVSS

SEQ ID NO: 210 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFFPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 211 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFFPGSGNTKYNEKFKGRVTITADTSTSTAYMELSSLRSEDTAVYYCAGSYYSYDVLDYWGQGTTVTVSS

SEQ ID NO: 212 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSPGSGNTKYNEKFKGRVTITADTSTSTAYMELSSLRSEDTAVYYCAVSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 213 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSPGSGNTKYNEKFKGRVTITADTSTSTAYMELSSLRSEDTAVYYCAVSYYSYDVLDYWGQGTTVTVSS

SEQ ID NO: 214 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSPGSGNTKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 215 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFSPGSGNTKYNEKFKGRVTITADTSTSTAYMELSSLRSEDTAVYYCAGSYYSYDVLDYWGQGTTVTVSS

SEQ ID NO: 216 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGRIFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 217 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGRIFPGSGNIKYNEKFKGRVTITADTSTSTAYMELSSLRSEDTAVYYCAGSYYSYDVLDYWGQGTTVTVSS

SEQ ID NO: 218 - protein, 246 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSIYSAGVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 219 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSIYSAGVLDYWGQGTTVTVSS

SEQ ID NO: 220 - protein, 246 aa, Artificial Sequence
  source: /note="Description of Artificial Sequence: Synthetic polypeptide"
QVQLVQSGAEVKKPGSSVKVSCKASGYSFTLGYIHWVRQAPGQGLEWMGWFFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 221 - protein, 119 aa, Artificial Sequence
  source: /note="Description of Artificial Sequence: Synthetic polypeptide"
QVQLVQSGAEVKKPGSSVKVSCKASGYSFTLGYIHWVRQAPGQGLEWMGWFFPGSGNIKYNEKFKGRVTITADTSTSTAYMELSSLRSEDTAVYYCAGSYYSYDVLDYWGQGTTVTVSS

SEQ ID NO: 222 - protein, 246 aa, Artificial Sequence
  source: /note="Description of Artificial Sequence: Synthetic polypeptide"
QVQLVQSGAEVKKPGSSVKVSCKASGYSFRLTYIHWVRQAPGQGLEWMGWFFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 223 - protein, 119 aa, Artificial Sequence
  source: /note="Description of Artificial Sequence: Synthetic polypeptide"
QVQLVQSGAEVKKPGSSVKVSCKASGYSFRLTYIHWVRQAPGQGLEWMGWFFPGSGNIKYNEKFKGRVTITADTSTSTAYMELSSLRSEDTAVYYCAGSYYSYDVLDYWGQGTTVTVSS

SEQ ID NO: 224 - protein, 246 aa, Artificial Sequence
  source: /note="Description of Artificial Sequence: Synthetic polypeptide"
QVQLVQSGAEVKKPGSSVKVSCKASGYSFHNWYIHWVRQAPGQGLEWMGWFFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 225 - protein, 119 aa, Artificial Sequence
  source: /note="Description of Artificial Sequence: Synthetic polypeptide"
QVQLVQSGAEVKKPGSSVKVSCKASGYSFHNWYIHWVRQAPGQGLEWMGWFFPGSGNIKYNEKFKGRVTITADTSTSTAYMELSSLRSEDTAVYYCAGSYYSYDVLDYWGQGTTVTVSS

SEQ ID NO: 226-229 - skipped (4 entries)

SEQ ID NO: 230 - protein, 107 aa, Artificial Sequence; identical to SEQ ID NO: 108
  source: /note="Description of Artificial Sequence: Synthetic polypeptide"
  VARIANT (30)..(30): /replace="Glu" or "Ala" or "Asp"
  VARIANT (31)..(31): /replace="Asp"
  VARIANT (32)..(32): /replace="Lys"
  VARIANT (36)..(36): /replace="His"
  VARIANT (56)..(56): /replace="Ser"
  SITE (1)..(107): /note="Variant residues given in the sequence have no preference with respect to those in the annotations for variant positions"

SEQ ID NO: 231 - protein, 119 aa, Artificial Sequence; identical to SEQ ID NO: 148
  source: /note="Description of Artificial Sequence: Synthetic polypeptide"
  VARIANT (27)..(27): /replace="Thr" or "Gly" or "Tyr"
  VARIANT (28)..(28): /replace="Thr" or "Ser"
  VARIANT (30)..(30): /replace="Arg" or "Asp" or "Lys" or "Thr"
  VARIANT (31)..(31): /replace="Asp" or "Lys" or "Thr" or "Asn"
  VARIANT (32)..(32): /replace="Phe" or "Thr" or "Ile" or "Tyr" or "Gly"
  VARIANT (50)..(50): /replace="Trp"
  VARIANT (51)..(51): /replace="Ile" or "Phe"
  VARIANT (52)..(52): /replace="Ser" or "Tyr"
  VARIANT (53)..(53): /replace="Pro"
  VARIANT (57)..(57): /replace="Ser"
  VARIANT (58)..(58): /replace="Val" or "Tyr" or "Ile"
  VARIANT (59)..(59): /replace="Arg"
  VARIANT (98)..(98): /replace="Val"
  VARIANT (100)..(100): /replace="Ile"
  VARIANT (103)..(103): /replace="Ala"
  VARIANT (104)..(104): /replace="Gly"
  SITE (1)..(119): /note="Variant residues given in the sequence have no preference with respect to those in the annotations for variant positions"

SEQ ID NO: 232 - protein, 107 aa, Artificial Sequence
  source: /note="Description of Artificial Sequence: Synthetic polypeptide"
DIQMTQTTSSLSASLGDRVTISCSASQGISNYLNWYQQKPDGTVKLLIYYTSSLHSGVPSRFSGSGSGTDYSLTISNLEPEDIATYYCQQYSKLPRTFGGGTKVEIK

SEQ ID NO: 233 - protein, 120 aa, Artificial Sequence
  source: /note="Description of Artificial Sequence: Synthetic polypeptide"
QVQLKESGPGLVAPSQSLSITCTVSGFSLTAYGVNWVRQPPGKGLEWLGMIWGDGNTDYNSALKSRLSISKDNSKSQVFLKMNSLQTDDTARYYCARDRVTATLYAMDYWGQGTSVTVSS

SEQ ID NO: 234-1003 - skipped (770 entries)

SEQ ID NO: 1004 - protein, 721 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIKGGGGSQVTLRESGPALVKPTQTLTLTCTFSGFSLSTSGMGVGWIRQPPGKALEWLAHIWWDDDKRYNPALKSRLTISKDTSKNQVFLTMTNMDPVDTATYYCARMELWSYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1005 - protein, 233 aa, Artificial Sequence
  source: /note="Description of Artificial Sequence: Synthetic polypeptide"
METPAQLLFLLLLWLPDTTGENVLTQSPATLSLSPGERATLSCSASSSVSYMHWYQQKPGQAPRLLIYDTSKLASGIPARFSGSGSGTDHTLTISSLEPEDFAVYYCFQGSVYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1006 - protein, 721 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIKGGGGSQVQLVESGGGVVQPGRSLRLSCAASGIDFSRYWMSWVRQAPGKGLEWVGEINPDSSTINYAPSLKDRFTISRDNSKNTLYLQMSSLRAEDTAVYYCASLYYDYGDAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1007 - protein, 234 aa, Artificial Sequence
  source: /note="Description of Artificial Sequence: Synthetic polypeptide"
METDTLLLWVLLLWVPGSTGDIQMTQSPSSLSASVGDRVTITCKASQSVDSNVAWYQQKPEKAPKALIFSASLRFSGVPSRFSGSGSGTDFTLTISSLQPEDFATYFCQQYNNYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1008-2169 - skipped (1162 entries)

SEQ ID NO: 2170 - protein, 114 aa, Artificial Sequence
  source: /note="Description of Artificial Sequence: Synthetic polypeptide"
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2171-2179 - skipped (9 entries)

SEQ ID NO: 2180 - protein, 77 aa, Artificial Sequence
  source: /note="Description of Artificial Sequence: Synthetic polypeptide"
MAPRRARGCRTLGLPALLLLLLLRPPATRGITCPPPMSVEHADIWVKSYSLYSRERYICNSGFKRKAGTSSLTECVL

SEQ ID NO: 2181-2189 - skipped (9 entries)

SEQ ID NO: 2190 - protein, 20 aa, Artificial Sequence
  source: /note="Description of Artificial Sequence: Synthetic peptide"
SGGSGGGGSGGGSGGGGSLQ

SEQ ID NO: 2191 - protein, 133 aa, Artificial Sequence [sequence omitted]

SEQ ID NO: 2192 - protein, 157 aa, Artificial Sequence
  source: /note="Description of Artificial Sequence: Synthetic polypeptide"
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 2193 - protein, 133 aa, Artificial Sequence [sequence omitted]

SEQ ID NO: 2194 - protein, 138 aa, Artificial Sequence
  source: /note="Description of Artificial Sequence: Synthetic polypeptide"
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 2195-2269 - skipped (75 entries)

SEQ ID NO: 2270 - protein, 133 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 2271-2279 - skipped (9 entries)

SEQ ID NO: 2280 - protein, 133 aa, Artificial Sequence
  source: /note="Description of Artificial Sequence: Synthetic polypeptide"
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLT

SEQ ID NO: 2281-2289 - skipped (9 entries)

SEQ ID NO: 2290 - protein, 518 aa, Artificial Sequence
  source: /note="Description of Artificial Sequence: Synthetic polypeptide"
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 2291-2299 - skipped (9 entries)

SEQ ID NO: 2300 - protein, 340 aa, Artificial Sequence
  source: /note="Description of Artificial Sequence: Synthetic polypeptide"
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGGGSGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 2301-2309 - skipped (9 entries)

SEQ ID NO: 2310 - protein, 166 aa, Artificial Sequence
  source: /note="Description of Artificial Sequence: Synthetic polypeptide"
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2311-2319 - skipped (9 entries)

SEQ ID NO: 2320 - protein, 114 aa, Artificial Sequence
  source: /note="Description of Artificial Sequence: Synthetic polypeptide"
NWVNVISDLKKIEDLIQSMHIDATLYTESDVHPSCKVTAMKCFLLELQVISLASGDASIHDTVENLIILANNSLSSNGAVTESGCKECEELEEKNIKEFLQSFVHIVQMFINTS

SEQ ID NO: 2321-2999 - skipped (679 entries)

SEQ ID NO: 3000 - protein, 107 aa, Artificial Sequence
  source: /note="Description of Artificial Sequence: Synthetic polypeptide"
DIQMTQSPSFLSASVGDRVTITCSASQGISNYLNWYQQKPGKAVKLLIYYTSSLHSGVPSRFSGSGSGTEYTLTISSLQPEDFATYYCQQYSKLPRTFGGGTKVEIK

SEQ ID NO: 3001 - protein, 107 aa, Artificial Sequence
  source: /note="Description of Artificial Sequence: Synthetic polypeptide"
DIQMTQSPSSLSASVGDRVTITCSASQGISNYLNWYQQKPGKAVKLLIYYTSSLHSGVPSRFSGSGSGTDYTLTISSLQPEDFATYYCQQYSKLPRTFGGGTKVEIK

SEQ ID NO: 3002 - protein, 107 aa, Artificial Sequence
  source: /note="Description of Artificial Sequence: Synthetic polypeptide"
DIQMTQSPSSLSASVGDRVTITCSASQGISNYLNWYQQKPGKVVKLLIYYTSSLHSGVPSRFSGSGSGTDYTLTISSLQPEDVATYYCQQYSKLPRTFGGGTKVEIK

SEQ ID NO: 3003 - protein, 107 aa, Artificial Sequence
  source: /note="Description of Artificial Sequence: Synthetic polypeptide"
DIQMTQSPSSLSASVGDRVTITCSASQGISNYLNWYQQKPGQAVKLLIYYTSSLHSGVPSRFSGSGSGTDYTLTISSLQPEDVATYYCQQYSKLPRTFGGGTKVEIK

SEQ ID NO: 3004 - protein, 107 aa, Artificial Sequence
  source: /note="Description of Artificial Sequence: Synthetic polypeptide"
DIQMTQSPSSLSASVGDRVTITCSASQGISNYLNWYQQKPGKAVKLLIYYTSSLHSGVPSRFSGSGSGTDYTFTISSLQPEDIATYYCQQYSKLPRTFGGGTKVEIK

SEQ ID NO: 3005 - protein, 107 aa, Artificial Sequence
  source: /note="Description of Artificial Sequence: Synthetic polypeptide"
DIQMTQSPSSLSASVGDRVTITCSASQGISNYLNWYQQKPGKTVKLLIYYTSSLHSGIPSRFSGSGSGTDYTLTIRSLQPEDFATYYCQQYSKLPRTFGGGTKVEIK

SEQ ID NO: 3006 - protein, 107 aa, Artificial Sequence
  source: /note="Description of Artificial Sequence: Synthetic polypeptide"
AIQMTQSPSSLSASVGDRVTITCSASQGISNYLNWYQQKPGKAVKLLIYYTSSLHSGVPSRFSGSGSGTDYTLTISSLQPEDFATYYCQQYSKLPRTFGGGTKVEIK

SEQ ID NO: 3007 - protein, 107 aa, Artificial Sequence
  source: /note="Description of Artificial Sequence: Synthetic polypeptide"
DIQMTQSPSSVSASVGDRVTITCSASQGISNYLNWYQQKPGKAVKLLIYYTSSLHSGVPSRFSGSGSGTDYTLTISSLQPEDFATYYCQQYSKLPRTFGGGTKVEIK

SEQ ID NO: 3008 - protein, 107 aa, Artificial Sequence
  source: /note="Description of Artificial Sequence: Synthetic polypeptide"
DIQMTQSPSSLSASVGDRVTITCSASQGISNYLNWYQQKPGKAVKRLIYYTSSLHSGVPSRFSGSGSGTEYTLTISNLQPEDFATYYCQQYSKLPRTFGGGTKVEIK

SEQ ID NO: 3009 - protein, 107 aa, Artificial Sequence
  source: /note="Description of Artificial Sequence: Synthetic polypeptide"
AIRMTQSPFSLSASVGDRVTITCSASQGISNYLNWYQQKPAKAVKLFIYYTSSLHSGVPSRFSGSGSGTDYTLTISSLQPEDFATYYCQQYSKLPRTFGGGTKVEIK

SEQ ID NO: 3010 - protein, 107 aa, Artificial Sequence
  source: /note="Description of Artificial Sequence: Synthetic polypeptide"
DIQMTQSPSSLSASVGDRVTITCSASQGISNYLNWYQQKPGKAVKRLIYYTSSLHSGVPSRFSGSGSGTEYTLTISSLQPEDFATYYCQQYSKLPRTFGGGTKVEIK

SEQ ID NO: 3011 - protein, 107 aa, Artificial Sequence
  source: /note="Description of Artificial Sequence: Synthetic polypeptide"
DIQMTQSPSTLSASVGDRVTITCSASQGISNYLNWYQQKPGKAVKLLIYYTSSLHSGVPSRFSGSGSGTEYTLTISSLQPDDFATYYCQQYSKLPRTFGGGTKVEIK

SEQ ID NO: 3012 - protein, 107 aa, Artificial Sequence
  source: /note="Description of Artificial Sequence: Synthetic polypeptide"
DIQMTQSPSSLSASVGDRVTITCSASQGISNYLNWYQQKPGKAVKSLIYYTSSLHSGVPSRFSGSGSGTDYTLTISSLQPEDFATYYCQQYSKLPRTFGGGTKVEIK

SEQ ID NO: 3013 - protein, 107 aa, Artificial Sequence
  source: /note="Description of Artificial Sequence: Synthetic polypeptide"
DIQMTQSPSSLSASVGDRVTITCSASQGISNYLNWYQQKPGKAVKSLIYYTSSLHSGVPSKFSGSGSGTDYTLTISSLQPEDFATYYCQQYSKLPRTFGGGTKVEIK

SEQ ID NO: 3014 - protein, 107 aa, Artificial Sequence
  source: /note="Description of Artificial Sequence: Synthetic polypeptide"
DIQMTQSPSSLSASVGDRVTITCSASQGISNYLNWYQQKPEKAVKSLIYYTSSLHSGVPSRFSGSGSGTDYTLTISSLQPEDFATYYCQQYSKLPRTFGGGTKVEIK

SEQ ID NO: 3015 - protein, 107 aa, Artificial Sequence
  source: /note="Description of Artificial Sequence: Synthetic polypeptide"
DIQMTQSPSAMSASVGDRVTITCSASQGISNYLNWYQQKPGKVVKRLIYYTSSLHSGVPSRFSGSGSGTEYTLTISSLQPEDFATYYCQQYSKLPRTFGGGTKVEIK

SEQ ID NO: 3016 - protein, 107 aa, Artificial Sequence
  source: /note="Description of Artificial Sequence: Synthetic polypeptide"
DIVMTQSPDSLAVSLGERATINCSASQGISNYLNWYQQKPGQPVKLLIYYTSSLHSGVPDRFSGSGSGTDYTLTISSLQAEDVAVYYCQQYSKLPRTFGGGTKVEIK

SEQ ID NO: 3017 - protein, 107 aa, Artificial Sequence
  source: /note="Description of Artificial Sequence: Synthetic polypeptide"
EIVMTQSPGTLSLSPGERATLSCSASQGISNYLNWYQQKPGQAVKLLIYYTSSLHSGIPDRFSGSGSGTDYTLTISRLEPEDFAVYYCQQYSKLPRTFGGGTKVEIK

SEQ ID NO: 3018 - protein, 107 aa, Artificial Sequence
  source: /note="Description of Artificial Sequence: Synthetic polypeptide"
EIVMTQSPPTLSLSPGERVTLSCSASQGISNYLNWYQQKPGQAVKLLIYYTSSLHSGIPARFSGSGSGTDYTLTISSLQPEDFAVYYCQQYSKLPRTFGGGTKVEIK

SEQ ID NO: 3019 - protein, 107 aa, Artificial Sequence
  source: /note="Description of Artificial Sequence: Synthetic polypeptide"
EIVMTQSPPTLSLSPGERVTLSCSASQGISNYLNWYQQKPGQAVKLLIYYTSSLHSSIPARFSGSGSGTDYTLTISSLQPEDFAVYYCQQYSKLPRTFGGGTKVEIK

SEQ ID NO: 3020 - protein, 107 aa, Artificial Sequence
  source: /note="Description of Artificial Sequence: Synthetic polypeptide"
EIVMTQSPATLSLSPGERATLSCSASQGISNYLNWYQQKPGQAVKLLIYYTSSLHSGIPARFSGSGSGTDYTLTISSLEPEDFAVYYCQQYSKLPRTFGGGTKVEIK

SEQ ID NO: 3021 - protein, 107 aa, Artificial Sequence
  source: /note="Description of Artificial Sequence: Synthetic polypeptide"
EIVMTQSPATLSLSPGERATLSCSASQGISNYLNWYQQKPGQAVKLLIYYTSSLHSGIPARFSGSGSGTDYTLTISRLEPEDFAVYYCQQYSKLPRTFGGGTKVEIK

SEQ ID NO: 3022 - protein, 107 aa, Artificial Sequence
  source: /note="Description of Artificial Sequence: Synthetic polypeptide"
EIVMTQSPATLSLSPGERATLSCSASQGISNYLNWYQQKPGQAVKLLIYYTSSLHSGIPDRFSGSGSGTDYTLTISRLEPEDFAVYYCQQYSKLPRTFGGGTKVEIK

SEQ ID NO: 3023 - protein, 107 aa, Artificial Sequence
  source: /note="Description of Artificial Sequence: Synthetic polypeptide"
EIVMTQSPATLSLSPGERATLSCSASQGISNYLNWYQQKPGLAVKLLIYYTSSLHSGIPDRFSGSGSGTDYTLTISRLEPEDFAVYYCQQYSKLPRTFGGGTKVEIK

SEQ ID NO: 3024 - protein, 107 aa, Artificial Sequence
  source: /note="Description of Artificial Sequence: Synthetic polypeptide"
DIQMIQSPSFLSASVGDRVSIICSASQGISNYLNWYLQKPGKSVKLFIYYTSSLHSGVSSRFSGRGSGTDYTLTIISLKPEDFAAYYCQQYSKLPRTFGGGTKVEIK

SEQ ID NO: 3025 - protein, 107 aa, Artificial Sequence
  source: /note="Description of Artificial Sequence: Synthetic polypeptide"
EIVMTQSPATLSLSPGERATLSCSASQGISNYLNWYQQKPGQAVKLLIYYTSSLHSGIPARFSGSGSGTDYTLTISSLQPEDFAVYYCQQYSKLPRTFGGGTKVEIK

SEQ ID NO: 3026 - protein, 107 aa, Artificial Sequence
  source: /note="Description of Artificial Sequence: Synthetic polypeptide"
EIVMTQSPATLSLSPGERATLSCSASQGISNYLNWYQQKPGQAVKLLIYYTSSLHSGIPARFSGSGPGTDYTLTISSLEPEDFAVYYCQQYSKLPRTFGGGTKVEIK

SEQ ID NO: 3027 - protein, 107 aa, Artificial Sequence
  source: /note="Description of Artificial Sequence: Synthetic polypeptide"
DIVMTQTPLSLSVTPGQPASISCSASQGISNYLNWYLQKPGQSVKLLIYYTSSLHSGVPDRFSGSGSGTDYTLKISRVEAEDVGVYYCQQYSKLPRTFGGGTKVEIK

SEQ ID NO: 3028 - protein, 107 aa, Artificial Sequence
  source: /note="Description of Artificial Sequence: Synthetic polypeptide"
DIVMTQTPLSLSVTPGQPASISCSASQGISNYLNWYLQKPGQPVKLLIYYTSSLHSGVPDRFSGSGSGTDYTLKISRVEAEDVGVYYCQQYSKLPRTFGGGTKVEIK

SEQ ID NO: 3029 - protein, 107 aa, Artificial Sequence
  source: /note="Description of Artificial Sequence: Synthetic polypeptide"
DIVMTQSPAFLSVTPGEKVTITCSASQGISNYLNWYQQKPDQAVKLLIYYTSSLHSGVPSRFSGSGSGTDYTFTISSLEAEDAATYYCQQYSKLPRTFGGGTKVEIK

SEQ ID NO: 3030 - protein, 107 aa, Artificial Sequence
  source: /note="Description of Artificial Sequence: Synthetic polypeptide"
DIVMTQSPLSLPVTPGEPASISCSASQGISNYLNWYLQKPGQSVKLLIYYTSSLHSGVPDRFSGSGSGTDYTLKISRVEAEDVGVYYCQQYSKLPRTFGGGTKVEIK

SEQ ID NO: 3031 - protein, 107 aa, Artificial Sequence
  source: /note="Description of Artificial Sequence: Synthetic polypeptide"
DIVMTQTPLSLPVTPGEPASISCSASQGISNYLNWYLQKPGQSVKLLIYYTSSLHSGVPDRFSGSGSGTDYTLKISRVEAEDVGVYYCQQYSKLPRTFGGGTKVEIK

SEQ ID NO: 3032 - protein, 107 aa, Artificial Sequence
  source: /note="Description of Artificial Sequence: Synthetic polypeptide"
EIVMTQSPATLSVSPGERATLSCSASQGISNYLNWYQQKPGQAVKLLIYYTSSLHSGIPARFSGSGSGTEYTLTISILQSEDFAVYYCQQYSKLPRTFGGGTKVEIK

SEQ ID NO: 3033 - protein, 107 aa, Artificial Sequence
  source: /note="Description of Artificial Sequence: Synthetic polypeptide"
EIVMTQSPATLSVSPGERATLSCSASQGISNYLNWYQQKPGQAVKLLIYYTSSLHSGIPARFSGSGSGTEYTLTISSLQSEDFAVYYCQQYSKLPRTFGGGTKVEIK

SEQ ID NO: 3034 - protein, 107 aa, Artificial Sequence
  source: /note="Description of Artificial Sequence: Synthetic polypeptide"
DIVMTQSPLSLPVTLGQPASISCSASQGISNYLNWYQQRPGQSVKRLIYYTSSLHSGVPDRFSGSGSGTDYTLKISRVEAEDVGVYYCQQYSKLPRTFGGGTKVEIK

SEQ ID NO: 3035 - protein, 107 aa, Artificial Sequence
  source: /note="Description of Artificial Sequence: Synthetic polypeptide"
EITMTQSPAFMSATPGDKVNISCSASQGISNYLNWYQQKPGEAVKFIIYYTSSLHSGIPPRFSGSGYGTDYTLTINNIESEDAAYYYCQQYSKLPRTFGGGTKVEIK

SEQ ID NO: 3036 - protein, 107 aa, Artificial Sequence
  source: /note="Description of Artificial Sequence: Synthetic polypeptide"
DIVMTQTPLSSPVTLGQPASISCSASQGISNYLNWYQQRPGQPVKLLIYYTSSLHSGVPDRFSGSGAGTDYTLKISRVEAEDVGVYYCQQYSKLPRTFGGGTKVEIK

SEQ ID NO: 3037 - protein, 107 aa, Artificial Sequence
  source: /note="Description of Artificial Sequence: Synthetic polypeptide"
EIVMTQSPDFQSVTPKEKVTITCSASQGISNYLNWYQQKPDQSVKLLIYYTSSLHSGVPSRFSGSGSGTDYTLTINSLEAEDAATYYCQQYSKLPRTFGGGTKVEIK

SEQ ID NO: 3038 - protein, 107 aa, Artificial Sequence
  source: /note="Description of Artificial Sequence: Synthetic polypeptide"
EIVMTQTPLSLSITPGEQASISCSASQGISNYLNWYLQKARPVVKLLIYYTSSLHSGVPDRFSGSGSGTDYTLKISRVEAEDFGVYYCQQYSKLPRTFGGGTKVEIK

SEQ ID NO: 3039 - protein, 107 aa, Artificial Sequence
  source: /note="Description of Artificial Sequence: Synthetic polypeptide"
EIVMTQTPLSLSITPGEQASMSCSASQGISNYLNWYLQKARPVVKLLIYYTSSLHSGVPDRFSGSGSGTDYTLKISRVEAEDFGVYYCQQYSKLPRTFGGGTKVEIK

SEQ ID NO: 3040 - protein, 120 aa, Artificial Sequence
  source: /note="Description of Artificial Sequence: Synthetic polypeptide"
QVTLKESGPVLVKPTETLTLTCTVSGFSLTAYGVNWVRQPPGKALEWLGMIWGDGNTDYNSALKSRLTISKDNSKSQVVLTMTNMDPVDTATYYCARDRVTATLYAMDYWGQGTLVTVSS

SEQ ID NO: 3041 - protein, 120 aa, Artificial Sequence
  source: /note="Description of Artificial Sequence: Synthetic polypeptide"
QVTLKESGPALVKPTETLTLTCTVSGFSLTAYGVNWVRQPPGKALEWLGMIWGDGNTDYNSALKSRLIISKDNSKSQVVLTMTNMDPVDTATYYCARDRVTATLYAMDYWGQGTLVTVSS

SEQ ID NO: 3042 - protein, 120 aa, Artificial Sequence
  source: /note="Description of Artificial Sequence: Synthetic polypeptide"
QVTLKESGPALVKPTQTLTLTCTVSGFSLTAYGVNWVRQPPGKALEWLGMIWGDGNTDYNSALKSRLTISKDNSKSQVVLTMTNMDPVDTATYYCARDRVTATLYAMDYWGQGTLVTVSS

SEQ ID NO: 3043 - protein, 120 aa, Artificial Sequence
  source: /note="Description of Artificial Sequence: Synthetic polypeptide"
QVQLQESGPGLVKPSGTLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3044 - protein, 120 aa, Artificial Sequence
  source: /note="Description of Artificial Sequence: Synthetic polypeptide"
QVTLKESGPTLVKPTQTLTLTCTVSGFSLTAYGVNWVRQPPGKALEWLGMIWGDGNTDYNSALKSRLTITKDNSKSQVVLTMTNMDPVDTATYYCARDRVTATLYAMDYWGQGTLVTVSS

SEQ ID NO: 3045 - protein, 120 aa, Artificial Sequence
  source: /note="Description of Artificial Sequence: Synthetic polypeptide"
QVTLKESGPALVKPTQTLTLTCTVSGFSLTAYGVNWVRQPPGKALEWLGMIWGDGNTDYNSALKSRLTITKDNSKSQVVLTMTNMDPVDTATYYCARDRVTATLYAMDYWGQGTLVTVSS

SEQ ID NO: 3046 - protein, 120 aa, Artificial Sequence
  source: /note="Description of Artificial Sequence: Synthetic polypeptide"
QVQLQESGPGLVKPSQTLSLTCTVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3047 - protein, 120 aa, Artificial Sequence
  source: /note="Description of Artificial Sequence: Synthetic polypeptide"
QVQLQESGPGLVKPSETLSLTCTVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3048 - protein, 120 aa, Artificial Sequence
  source: /note="Description of Artificial Sequence: Synthetic polypeptide"
QVQLQESGPGLVKPSQTLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3049 - protein, 120 aa, Artificial Sequence
  source: /note="Description of Artificial Sequence: Synthetic polypeptide"
QVQLQESGPGLVKPSDTLSLTCTVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3050 - protein, 120 aa, Artificial Sequence
  source: /note="Description of Artificial Sequence: Synthetic polypeptide"
QVQLQESGPGLVKPSQTLSLTCTVSGFSLTAYGVNWVRQHPGKGLEWLGMIWGDGNTDYNSALKSRLTISKDNSKSQVSLKLSSVTAADTAVYYCARDRVTATLYAMDYWGQGTLVTVSS

SEQ ID NO: 3051 - protein, 120 aa, Artificial Sequence
  source: /note="Description of Artificial Sequence: Synthetic polypeptide"
QVQLQESGPGLVKPSQTLSLTCTVSGFSLTAYGVNWVRQPAGKGLEWLGMIWGDGNTDYNSALKSRLTISKDNSKSQVSLKLSSVTAADTAVYYCARDRVTATLYAMDYWGQGTLVTVSS

SEQ ID NO: 3052 - protein, 120 aa, Artificial Sequence
  source: /note="Description of Artificial Sequence: Synthetic polypeptide"
QVQLQESGPGLVKPSQTLSLTCAVSGFSLTAYGVNWVRQPPGKGLEWLGMIWGDGNTDYNSALKSRLTISKDNSKSQVSLKLSSVTAVDTAVYYCARDRVTATLYAMDYWGQGTLVTVSS

SEQ ID NO: 3053 - protein, 120 aa, Artificial Sequence
  source: /note="Description of Artificial Sequence: Synthetic polypeptide"
QVQLQESGPGLVKPSETLSLTCTVSGFSLTAYGVNWVRQPPGKGLEWLGMIWGDGNTDYNSALKSRLTISKDNSKSHVSLKLSSVTAADTAVYYCARDRVTATLYAMDYWGQGTLVTVSS

SEQ ID NO: 3054 - protein, 120 aa, Artificial Sequence
  source: /note="Description of Artificial Sequence: Synthetic polypeptide"
QVQLQESGPGLVKPSETLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3055 - protein, 120 aa, Artificial Sequence
  source: /note="Description of Artificial Sequence: Synthetic polypeptide"
QVQLQESGPGLVKPSQTLSLTCAVYGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3056 - protein, 120 aa, Artificial Sequence
  source: /note="Description of Artificial Sequence: Synthetic polypeptide"
RVQLQESGPGLVKPSETLSLTCTVSGFSLTAYGVNWVRQPPGKGLEWLGMIWGDGNTDYNSALKSRLTISKDNSKSQVPLKLSSVTAADTAVYYCARDRVTATLYAMDYWGQGTLVTVSS

SEQ ID NO: 3057 - protein, 120 aa, Artificial Sequence
  source: /note="Description of Artificial Sequence: Synthetic polypeptide"
QVQLQESGPGLVKPSQTLSLTCTVSGFSLTAYGVNWVRQHPGKGLEWLGMIWGDGNTDYNSALKSLLTISKDNSKSQVSLKLSSVTAADTAVYYCARDRVTATLYAMDYWGQGTLVTVSS

SEQ ID NO: 3058 - protein, 120 aa, Artificial Sequence
  source: /note="Description of Artificial Sequence: Synthetic polypeptide"
QVQLQESGPGLVKPSDTLSLTCAVSGFSLTAYGVNWVRQPPGKGLEWLGMIWGDGNTDYNSALKSRLTISKDNSKSQVSLKLSSVTALDTAVYYCARDRVTATLYAMDYWGQGTLVTVSS

SEQ ID NO: 3059 - protein, 120 aa, Artificial Sequence
  source: /note="Description of Artificial Sequence: Synthetic polypeptide"
QVQLQESGPGLVKPSDTLSLTCAVSGFSLTAYGVNWVRQPPGKGLEWLGMIWGDGNTDYNSALKSRLTISKDNSKSQVSLKLSSVTAVDTAVYYCARDRVTATLYAMDYWGQGTLVTVSS

SEQ ID NO: 3060 - protein, 120 aa, Artificial Sequence
  source: /note="Description of Artificial Sequence: Synthetic polypeptide"
QVQLQESGSGLVKPSQTLSLTCAVSGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3061 - protein, 120 aa, Artificial Sequence
  source: /note="Description of Artificial Sequence: Synthetic polypeptide"
EVQLVESGGGLVQPGRSLRLSCTVSGFSLTAYGVNWVRQAPGKGLEWLGMIWGDGNTDYNSALKSRLTISKDNSKSIVYLQMNSLKTEDTAVYYCARDRVTATLYAMDYWGQGTLVTVSS

SEQ ID NO: 3062 - protein, 120 aa, Artificial Sequence
  source: /note="Description of Artificial Sequence: Synthetic polypeptide"
EVQLVESGGGLVQPGPSLRLSCTVSGFSLTAYGVNWVRQAPGKGLEWLGMIWGDGNTDYNSALKSRLTISKDNSKSIVYLQMNSLKTEDTAVYYCARDRVTATLYAMDYWGQGTLVTVSS

SEQ ID NO: 3063 - protein, 120 aa, Artificial Sequence
  source: /note="Description of Artificial Sequence: Synthetic polypeptide"
QVQLQESGSGLVKPSQTLSLTCAVSGFSLTAYGVNWVRQSPGKGLEWLGMIWGDGNTDYNSALKSRLTISKDNSKSQVSLKLSSVTAADTAVYYCARDRVTATLYAMDYWGQGTLVTVSS

SEQ ID NO: 3064 - protein, 120 aa, Artificial Sequence
  source: /note="Description of Artificial Sequence: Synthetic polypeptide"
QVQLQESGPGLVKPSETLSLTCTVSGFSLTAYGVNWVRQPAGKGLEWLGMIWGDGNTDYNSALKSRLTISKDNSKSQVSLKLSSVTAADTAVYYCARDRVTATLYAMDYWGQGTLVTVSS

SEQ ID NO: 3065 - protein, 120 aa, Artificial Sequence
  source: /note="Description of Artificial Sequence: Synthetic polypeptide"
EVQLVESGGGLVKPGRSLRLSCTVSGFSLTAYGVNWVRQAPGKGLEWLGMIWGDGNTDYNSALKSRLTISKDNSKSIVYLQMNSLKTEDTAVYYCARDRVTATLYAMDYWGQGTLVTVSS

SEQ ID NO: 3066 - protein, 120 aa, Artificial Sequence
  source: /note="Description of Artificial Sequence: Synthetic polypeptide"
QVQLQESGPGLVKPSETLSLTCAVYGFSLTAYGVNWVRQPPGKGLEWLGMIWGDGNTDYNSALKSRLTISKDNSKSQVYLKLSSVTAADTAVYYCARDRVTATLYAMDYWGQGTLVTVSS

SEQ ID NO: 3067 - protein, 120 aa, Artificial Sequence
  source: /note="Description of Artificial Sequence: Synthetic polypeptide"
QVQLQESGPGLVKPSDTLSLTCAVSGFSLTAYGVNWVRQPPGKGLEWLGMIWGDGNTDYNSALKSRLTISKDNSKSQVSLKLSSVTAVDTGVYYCARDRVTATLYAMDYWGQGTLVTVSS

SEQ ID NO: 3068 - protein, 120 aa, Artificial Sequence
  source: /note="Description of Artificial Sequence: Synthetic polypeptide"
EVQLVESGGGLVQPGGSLRLSCAVSGFSLTAYGVNWVRQAPGKGLEWLGMIWGDGNTDYNSALKSRLTISKDNSKSSVYLQMNSLKTEDTAVYYCARDRVTATLYAMDYWGQGTLVTVSS

SEQ ID NO: 3069 - protein, 120 aa, Artificial Sequence
  source: /note="Description of Artificial Sequence: Synthetic polypeptide"
EVQLVESGGGLVKPGGSLRLSCAVSGFSLTAYGVNWVRQAPGKGLEWLGMIWGDGNTDYNSALKSRLTISKDNSKSTVYLQMNSLKTEDTAVYYCARDRVTATLYAMDYWGQGTLVTVSS

SEQ ID NO: 3070 - protein, 120 aa, Artificial Sequence
  source: /note="Description of Artificial Sequence: Synthetic polypeptide"
QVQLQQSGPGLVKPSQTLSLTCAVSGFSLTAYGVNWVRQSPSRGLEWLGMIWGDGNTDYNSALKSRLTINKDNSKSQVSLQLNSVTPEDTAVYYCARDRVTATLYAMDYWGQGTLVTVSS

SEQ ID NO: 3071 - protein, 120 aa, Artificial Sequence
  source: /note="Description of Artificial Sequence: Synthetic polypeptide"
QVQLVESGGGLVQPGGSLRLSCSVSGFSLTAYGVNWVRQAPGKGLEWLGMIWGDGNTDYNSALKSRLTISKDNSKSTVYLQMNSLRAEDTAVYYCARDRVTATLYAMDYWGQGTLVTVSS

SEQ ID NO: 3072 - protein, 120 aa, Artificial Sequence
  source: /note="Description of Artificial Sequence: Synthetic polypeptide"
QVQLQQWGAGLLKPSETLSLTCAVYGFSLTAYGVNWVRQPPGKGLEWLGMIWGDGNTDYNSALKSRLTISKDNSKSQVSLKLSSVTAADTAVYYCARDRVTATLYAMDYWGQGTLVTVSS

SEQ ID NO: 3073 - protein, 120 aa, Artificial Sequence
  source: /note="Description of Artificial Sequence: Synthetic polypeptide"
QVQLVESGGGVVQPGRSLRLSCAVSGFSLTAYGVNWVRQAPGKGLEWLGMIWGDGNTDYNSALKSRLTISKDNSTSTVFLQMNSLRAEDTAVYYCARDRVTATLYAMDYWGQGTLVTVSS

SEQ ID NO: 3074 - protein, 120 aa, Artificial Sequence
  source: /note="Description of Artificial Sequence: Synthetic polypeptide"
EVQLVESGGGLVQPGGSLRLSCAVSGFSLTAYGVNWVRQAPGKGLEWLGMIWGDGNTDYNSALKSRLTISKDNSKSTVYLQMNSLRAEDTAVYYCARDRVTATLYAMDYWGQGTLVTVSS

SEQ ID NO: 3075 - protein, 120 aa, Artificial Sequence
  source: /note="Description of Artificial Sequence: Synthetic polypeptide"
EVQLVESGGGLVQPGGSLRLSCAVSGFSLTAYGVNWVRQAPGKGLEWLGMIWGDGNTDYNSALKSRLTISKDNAKSSVYLQMNSLRDEDTAVYYCARDRVTATLYAMDYWGQGTLVTVSS

SEQ ID NO: 3076 - protein, 120 aa, Artificial Sequence
  source: /note="Description of Artificial Sequence: Synthetic polypeptide"
EVQLLESGGGLVQPGGSLRLSCAVSGFSLTAYGVNWVRQAPGKGLEWLGMIWGDGNTDYNSALKSRLTISKDNSKSTVYLQMNSLRAEDTAVYYCARDRVTATLYAMDYWGQGTLVTVSS

SEQ ID NO: 3077 - protein, 120 aa, Artificial Sequence
  source: /note="Description of Artificial Sequence: Synthetic polypeptide"
QVQLVESGGGLVKPGGSLRLSCAVSGFSLTAYGVNWVRQAPGKGLEWLGMIWGDGNTDYNSALKSRLTISKDNAKSSVYLQMNSLRAEDTAVYYCARDRVTATLYAMDYWGQGTLVTVSS

SEQ ID NO: 3078 - protein, 120 aa, Artificial Sequence
  source: /note="Description of Artificial Sequence: Synthetic polypeptide"
EVQLVESGGGLVQPGGSLKLSCAVSGFSLTAYGVNWVRQASGKGLEWLGMIWGDGNTDYNSALKSRLTISKDNSKSTVYLQMNSLKTEDTAVYYCARDRVTATLYAMDYWGQGTLVTVSS

SEQ ID NO: 3079 - protein, 120 aa, Artificial Sequence
  source: /note="Description of Artificial Sequence: Synthetic polypeptide"
QVQLLESGGGLVKPGGSLRLSCAVSGFSLTAYGVNWVRQAPGKGLEWLGMIWGDGNTDYNSALKSRLTISKDNAKSSVYLQMNSLRAEDTAVYYCARDRVTATLYAMDYWGQGTLVTVSS

SEQ ID NO: 3080 - protein, 120 aa, Artificial Sequence
  source: /note="Description of Artificial Sequence: Synthetic polypeptide"
QVQLVESGGGVVQPGRSLRLSCAVSGFSLTAYGVNWVRQAPGKGLEWLGMIWGDGNTDYNSALKSRLTISKDNSKSTVYLQMNSLRAEDTAVYYCARDRVTATLYAMDYWGQGTLVTVSS

SEQ ID NO: 3081 - protein, 120 aa, Artificial Sequence
  source: /note="Description of Artificial Sequence: Synthetic polypeptide"
QVQLVESGGGVVQPGRSLRLSCAVSGFSLTAYGVNWVRQAPGKGLEWLGMIWGDGNTDYNSALKSRLTISKDNSKSRVYLQMNSLRAEDTAVYYCARDRVTATLYAMDYWGQGTLVTVSS

SEQ ID NO: 3082 - protein, 120 aa, Artificial Sequence
  source: /note="Description of Artificial Sequence: Synthetic polypeptide"
QVQLVESGGGVVQPGRSLRLSCAVSGFSLTAYGVNWVRQAPGKGLEWLGMIWGDGNTDYNSALKSRLAISKDNSKSTVYLQMNSLRAEDTAVYYCARDRVTATLYAMDYWGQGTLVTVSS

SEQ ID NO: 3083 - protein, 120 aa, Artificial Sequence
  source: /note="Description of Artificial Sequence: Synthetic polypeptide"
QVQLVESGGGVVQPGGSLRLSCAVSGFSLTAYGVNWVRQAPGKGLEWLGMIWGDGNTDYNSALKSRLTISKDNSKSTVYLQMNSLRAEDTAVYYCARDRVTATLYAMDYWGQGTLVTVSS

SEQ ID NO: 3084 - protein, 120 aa, Artificial Sequence
  source: /note="Description of Artificial Sequence: Synthetic polypeptide"
EVQLVESGGGLVQPGGSLRLSCAVSGFSLTAYGVNWVRQAPGKGLEWLGMIWGDGNTDYNSALKSRLTISKDNAKSTVYLQMNSLRAEDTAVYYCARDRVTATLYAMDYWGQGTLVTVSS

SEQ ID NO: 3085 - protein, 120 aa, Artificial Sequence
  source: /note="Description of Artificial Sequence: Synthetic polypeptide"
EVQLVESGGGLVQPGGSLRLSCAVSGFSLTAYGVNWVRQAPGKGLEWLGMIWGDGNTDYNSALKSRLTISKDNAKSSVYLQMNSLRAEDTAVYYCARDRVTATLYAMDYWGQGTLVTVSS

SEQ ID NO: 3086 - protein, 120 aa, Artificial Sequence
  source: /note="Description of Artificial Sequence: Synthetic polypeptide"
EVQLVESGGVVVQPGGSLRLSCAVSGFSLTAYGVNWVRQAPGKGLEWLGMIWGDGNTDYNSALKSRLTISKDNSKSSVYLQMNSLRTEDTALYYCARDRVTATLYAMDYWGQGTLVTVSS

SEQ ID NO: 3087 - protein, 120 aa, Artificial Sequence
  source: /note="Description of Artificial Sequence: Synthetic polypeptide"
EVQLVESGGGLVQPGGSLRLSCAVSGFSLTAYGVNWVRQAPGKGLEWLGMIWGDGNTDYNSALKSRLTISKHNSKSTVYLQMNSLRAEDTAVYYCARDRVTATLYAMDYWGQGTLVTVSS

SEQ ID NO: 3088 - protein, 120 aa, Artificial Sequence
  source: /note="Description of Artificial Sequence: Synthetic polypeptide"
EVQLVESGGGLVKPGGSLRLSCAVSGFSLTAYGVNWVRQAPGKGLEWLGMIWGDGNTDYNSALKSRLTISKDNAKSSVYLQMNSLRAEDTAVYYCARDRVTATLYAMDYWGQGTLVTVSS

SEQ ID NO: 3089 - protein, 120 aa, Artificial Sequence
  source: /note="Description of Artificial Sequence: Synthetic polypeptide"
EVQLVESGGGLIQPGGSLRLSCAVSGFSLTAYGVNWVRQPPGKGLEWLGMIWGDGNTDYNSALKSRLTISKDNSKSTVYLQMNSLRAEDTAVYYCARDRVTATLYAMDYWGQGTLVTVSS

SEQ ID NO: 3090 - skipped

SEQ ID NO: 3091 - protein, 119 aa, Artificial Sequence
  source: /note="Description of Artificial Sequence: Synthetic polypeptide"
QVQLQQSGPELVKPGASVKISCKASGYAFSSSWMNWVKQRPGQGLEWIGRIYPGDGDTKYNGKFKGKATLTADKSSSTAYMHLSSLTSVDSAVYFCARRGTGGWYFDVWGAGTTVTVSS

SEQ ID NO: 3092 - protein, 111 aa, Artificial Sequence
  source: /note="Description of Artificial Sequence: Synthetic polypeptide"
DIVLTQSPASLAVSLGQRATISCRASESVDSSGNSFMHWYQQKPGQPPQLLIYRASNLESGIPARFSGSGSRTDFTLTINPVEADDVATFYCQQSFDDPFTFGSGTKLEIK

SEQ ID NO: 3093 - protein, 111 aa, Artificial Sequence
  source: /note="Description of Artificial Sequence: Synthetic polypeptide"
DIVLTQSPDSLAVSLGERATINCRASESVDSSGNSFMHWYQQKPGQPPQLLIYRASNLESGVPDRFSGSGSRTDFTLTISSLQAEDVAVYYCQQSFDDPFTFGQGTKLEIK

SEQ ID NO: 3094 - protein, 111 aa, Artificial Sequence
  source: /note="Description of Artificial Sequence: Synthetic polypeptide"
EIVLTQSPATLSLSPGERATLSCRASESVDSSGNSFMHWYQQKPGQAPQLLIYRASNLESGIPARFSGSGSRTDFTLTISSLEPEDFAVYYCQQSFDDPFTFGQGTKLEIK

SEQ ID NO: 3095 - protein, 111 aa, Artificial Sequence
  source: /note="Description of Artificial Sequence: Synthetic polypeptide"
EIVLTQSPATLSLSPGERATLSCRASESVDSSGNSFMHWYQQKPGQAPQLLIYRASNLESGIPARFSGSGSRTDFTLTISRLEPEDFAVYYCQQSFDDPFTFGQGTKLEIK

SEQ ID NO: 3096 - protein, 111 aa, Artificial Sequence
  source: /note="Description of Artificial Sequence: Synthetic polypeptide"
EIVLTQSPATLSLSPGERATLSCRASESVDSSGNSFMHWYQQKPGQAPQLLIYRASNLESGIPARFSGSGSRTDFTLTISSLQPEDFAVYYCQQSFDDPFTFGQGTKLEIK

SEQ ID NO: 3097 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGQAPQLLIYRASNLESGVPSRFSGSGSRTDFTLTISSLQPEDVATYYCQQSFDDPFTFGQGTKLEIK

SEQ ID NO: 3098 - protein, 111 aa, Artificial Sequence
  source: /note="Description of Artificial Sequence: Synthetic polypeptide"
EIVLTQSPATLSLSPGERATLSCRASESVDSSGNSFMHWYQQKPGQAPQLLIYRASNLESGIPARFSGSGPRTDFTLTISSLEPEDFAVYYCQQSFDDPFTFGQGTKLEIK

SEQ ID NO: 3099 - protein, 111 aa, Artificial Sequence
  source: /note="Description of Artificial Sequence: Synthetic polypeptide"
EIVLTQSPATLSLSPGERATLSCRASESVDSSGNSFMHWYQQKPGQAPQLLIYRASNLESGIPDRFSGSGSRTDFTLTISRLEPEDFAVYYCQQSFDDPFTFGQGTKLEIK

SEQ ID NO: 3100 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKVPQLLIYRASNLESGVPSRFSGSGSRTDFTLTISSLQPEDVATYYCQQSFDDPFTFGQGTKLEIK

SEQ ID NO: 3101 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKTPQLLIYRASNLESGIPSRFSGSGSRTDFTLTIRSLQPEDFATYYCQQSFDDPFTFGQGTKLEIK

SEQ ID NO: 3102 - protein, 111 aa, Artificial Sequence
  source: /note="Description of Artificial Sequence: Synthetic polypeptide"
EIVLTQSPGTLSLSPGERATLSCRASESVDSSGNSFMHWYQQKPGQAPQLLIYRASNLESGIPDRFSGSGSRTDFTLTISRLEPEDFAVYYCQQSFDDPFTFGQGTKLEIK

SEQ ID NO: 3103 - protein, 111 aa, Artificial Sequence
  source: /note="Description of Artificial Sequence: Synthetic polypeptide"
EIVLTQSPATLSLSPGERATLSCRASESVDSSGNSFMHWYQQKPGLAPQLLIYRASNLESGIPDRFSGSGSRTDFTLTISRLEPEDFAVYYCQQSFDDPFTFGQGTKLEIK

SEQ ID NO: 3104 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKAPQLLIYRASNLESGVPSRFSGSGSRTDFTLTISSLQPEDFATYYCQQSFDDPFTFGQGTKLEIK

SEQ ID NO: 3105 - protein, 111 aa, Artificial Sequence
  source: /note="Description of Artificial Sequence: Synthetic polypeptide"
DIQLTQSPSSVSASVGDRVTITCRASESVDSSGNSFMHWYQQKPGKAPQLLIYRASNLESGVPSRFSGSGSRTDFTLTISSLQPEDFATYYCQQSFDDPFTFGQGTKLEIK

SEQ ID NO: 3106 - protein, 111 aa, Artificial Sequence
  source: /note="Description of Artificial Sequence: Synthetic polypeptide"
AIQLTQSPSSLSASVGDRVTITCRASESVDSSGNSFMHWYQQKPGKAPQLLIYRASNLESGVPSRFSGSGSRTDFTLTISSLQPEDFATYYCQQSFDDPFTFGQGTKLEIK

SEQ ID NO: 3107 - protein, 111 aa, Artificial Sequence
  source: /note="Description of Artificial Sequence: Synthetic polypeptide"
DIQLTQSPSFLSASVGDRVTITCRASESVDSSGNSFMHWYQQKPGKAPQLLIYRASNLESGVPSRFSGSGSRTEFTLTISSLQPEDFATYYCQQSFDDPFTFGQGTKLEIK

SEQ ID NO: 3108 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKAPQLLIYRASNLESGVPSRFSGSGSRTDFTFTISSLQPEDIATYYCQQSFDDPFTFGQGTKLEIK

SEQ ID NO: 3109 - protein, 111 aa, Artificial Sequence
  source: /note="Description of Artificial Sequence: Synthetic polypeptide"
EIVLTQSPATLSVSPGERATLSCRASESVDSSGNSFMHWYQQKPGQAPQLLIYRASNLESGIPARFSGSGSRTEFTLTISILQSEDFAVYYCQQSFDDPFTFGQGTKLEIK

SEQ ID NO: 3110 - protein, 111 aa, Artificial Sequence
  source: /note="Description of Artificial Sequence: Synthetic polypeptide"
EIVLTQSPATLSVSPGERATLSCRASESVDSSGNSFMHWYQQKPGQAPQLLIYRASNLESGIPARFSGSGSRTEFTLTISSLQSEDFAVYYCQQSFDDPFTFGQGTKLEIK

SEQ ID NO: 3111 - protein, 111 aa, Artificial Sequence
  source: /note="Description of Artificial Sequence: Synthetic polypeptide"
AIRLTQSPFSLSASVGDRVTITCRASESVDSSGNSFMHWYQQKPAKAPQLFIYRASNLESGVPSRFSGSGSRTDFTLTISSLQPEDFATYYCQQSFDDPFTFGQGTKLEIK

SEQ ID NO: 3112 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKAPQSLIYRASNLESGVPSRFSGSGSRTDFTLTISSLQPEDFATYYCQQSFDDPFTFGQGTKLEIK

SEQ ID NO: 3113 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKAPQRLIYRASNLESGVPSRFSGSGSRTEFTLTISNLQPEDFATYYCQQSFDDPFTFGQGTKLEIK

SEQ ID NO: 3114 - protein, 111 aa, Artificial Sequence
  source: /note="Description of Artificial Sequence: Synthetic polypeptide"
DIQLTQSPSTLSASVGDRVTITCRASESVDSSGNSFMHWYQQKPGKAPQLLIYRASNLESGVPSRFSGSGSRTEFTLTISSLQPDDFATYYCQQSFDDPFTFGQGTKLEIK

SEQ ID NO: 3115 - protein, 111 aa, Artificial Sequence
  source: /note="Description of Artificial Sequence: Synthetic polypeptide"
EIVLTQSPDFQSVTPKEKVTITCRASESVDSSGNSFMHWYQQKPDQSPQLLIYRASNLESGVPSRFSGSGSRTDFTLTINSLEAEDAATYYCQQSFDDPFTFGQGTKLEIK

SEQ ID NO: 3116 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKAPQSLIYRASNLESGVPSKFSGSGSRTDFTLTISSLQPEDFATYYCQQSFDDPFTFGQGTKLEIK

SEQ ID NO: 3117 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPGKAPQRLIYRASNLESGVPSRFSGSGSRTEFTLTISSLQPEDFATYYCQQSFDDPFTFGQGTKLEIK

SEQ ID NO: 3118 - protein, 111 aa, Artificial Sequence
  source: /note="Description of Artificial Sequence: Synthetic polypeptide"
DIVLTQTPLSLSVTPGQPASISCRASESVDSSGNSFMHWYLQKPGQPPQLLIYRASNLESGVPDRFSGSGSRTDFTLKISRVEAEDVGVYYCQQSFDDPFTFGQGTKLEIK

SEQ ID NO: 3119 - protein, 111 aa, Artificial Sequence
  source: /note="Description of Artificial Sequence: Synthetic polypeptide"
DIQLTQSPSSLSASVGDRVTITCRASESVDSSGNSFMHWYQQKPEKAPQSLIYRASNLESGVPSRFSGSGSRTDFTLTISSLQPEDFATYYCQQSFDDPFTFGQGTKLEIK

SEQ ID NO: 3120 - protein, 111 aa, Artificial Sequence
  source: /note="Description of Artificial Sequence: Synthetic polypeptide"
EIVLTQSPPTLSLSPGERVTLSCRASESVDSSGNSFMHWYQQKPGQAPQLLIYRASNLESGIPARFSGSGSRTDFTLTISSLQPEDFAVYYCQQSFDDPFTFGQGTKLEIK

SEQ ID NO: 3121 - protein, 111 aa, Artificial Sequence
  source: /note="Description of Artificial Sequence: Synthetic polypeptide"
DIQLTQSPSAMSASVGDRVTITCRASESVDSSGNSFMHWYQQKPGKVPQRLIYRASNLESGVPSRFSGSGSRTEFTLTISSLQPEDFATYYCQQSFDDPFTFGQGTKLEIK

SEQ ID NO: 3122 - protein, 111 aa, Artificial Sequence
  source: /note="Description of Artificial Sequence: Synthetic polypeptide"
DIVLTQSPLSLPVTPGEPASISCRASESVDSSGNSFMHWYLQKPGQSPQLLIYRASNLESGVPDRFSGSGSRTDFTLKISRVEAEDVGVYYCQQSFDDPFTFGQGTKLEIK

SEQ ID NO: 3123 - protein, 111 aa, Artificial Sequence
  source: /note="Description of Artificial Sequence: Synthetic polypeptide"
DIVLTQTPLSLPVTPGEPASISCRASESVDSSGNSFMHWYLQKPGQSPQLLIYRASNLESGVPDRFSGSGSRTDFTLKISRVEAEDVGVYYCQQSFDDPFTFGQGTKLEIK

SEQ ID NO: 3124 - protein, 111 aa, Artificial Sequence
  source: /note="Description of Artificial Sequence: Synthetic polypeptide"
DIVLTQTPLSLSVTPGQPASISCRASESVDSSGNSFMHWYLQKPGQSPQLLIYRASNLESGVPDRFSGSGSRTDFTLKISRVEAEDVGVYYCQQSFDDPFTFGQGTKLEIK

SEQ ID NO: 3125 - protein, 111 aa, Artificial Sequence
  source: /note="Description of Artificial Sequence: Synthetic polypeptide"
EIVLTQSPPTLSLSPGERVTLSCRASESVDSSGNSFMHWYQQKPGQAPQLLIYRASNLESSIPARFSGSGSRTDFTLTISSLQPEDFAVYYCQQSFDDPFTFGQGTKLEIK

SEQ ID NO: 3126 - protein, 111 aa, Artificial Sequence
  source: /note="Description of Artificial Sequence: Synthetic polypeptide"
DIVLTQSPLSLPVTLGQPASISCRASESVDSSGNSFMHWYQQRPGQSPQRLIYRASNLESGVPDRFSGSGSRTDFTLKISRVEAEDVGVYYCQQSFDDPFTFGQGTKLEIK

SEQ ID NO: 3127 - protein, 111 aa, Artificial Sequence
  source: /note="Description of Artificial Sequence: Synthetic polypeptide"
DIVLTQTPLSSPVTLGQPASISCRASESVDSSGNSFMHWYQQRPGQPPQLLIYRASNLESGVPDRFSGSGARTDFTLKISRVEAEDVGVYYCQQSFDDPFTFGQGTKLEIK

SEQ ID NO: 3128 - protein, 111 aa, Artificial Sequence
  source: /note="Description of Artificial Sequence: Synthetic polypeptide"
DIVLTQSPAFLSVTPGEKVTITCRASESVDSSGNSFMHWYQQKPDQAPQLLIYRASNLESGVPSRFSGSGSRTDFTFTISSLEAEDAATYYCQQSFDDPFTFGQGTKLEIK

SEQ ID NO: 3129 - protein, 111 aa, Artificial Sequence
  source: /note="Description of Artificial Sequence: Synthetic polypeptide"
DIQLIQSPSFLSASVGDRVSIICRASESVDSSGNSFMHWYLQKPGKSPQLFIYRASNLESGVSSRFSGRGSRTDFTLTIISLKPEDFAAYYCQQSFDDPFTFGQGTKLEIK

SEQ ID NO: 3130 - protein, 111 aa, Artificial Sequence
  source: /note="Description of Artificial Sequence: Synthetic polypeptide"
EIVLTQTPLSLSITPGEQASISCRASESVDSSGNSFMHWYLQKARPVPQLLIYRASNLESGVPDRFSGSGSRTDFTLKISRVEAEDFGVYYCQQSFDDPFTFGQGTKLEIK

SEQ ID NO: 3131 - protein, 111 aa, Artificial Sequence
  source: /note="Description of Artificial Sequence: Synthetic polypeptide"
EIVLTQTPLSLSITPGEQASMSCRASESVDSSGNSFMHWYLQKARPVPQLLIYRASNLESGVPDRFSGSGSRTDFTLKISRVEAEDFGVYYCQQSFDDPFTFGQGTKLEIK

SEQ ID NO: 3132 - protein, 111 aa, Artificial Sequence
  source: /note="Description of Artificial Sequence: Synthetic polypeptide"
EITLTQSPAFMSATPGDKVNISCRASESVDSSGNSFMHWYQQKPGEAPQFIIYRASNLESGIPPRFSGSGYRTDFTLTINNIESEDAAYYYCQQSFDDPFTFGQGTKLEIK

SEQ ID NO: 3133 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQGLEWIGRIYPGDGDTKYNGKFKGRATLTADKSTSTAYMELSSLRSEDTAVYYCARRGTGGWYFDVWGQGTTVTVSS

SEQ ID NO: 3134 - protein, 119 aa, Artificial Sequence
  source: /note="Description of Artificial Sequence: Synthetic polypeptide"
QVQLVQSGAEVKKPGSSVKVSCKASGYAFSSSWMNWVRQAPGQGLEWIGRIYPGDGDTKYNGKFKGRATLTADKSTSTAYMELSSLRSEDTAVYYCARRGTGGWYFDVWGQGTTVTVSS

SEQ ID NO: 3135 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGKGLEWIGRIYPGDGDTKYNGKFKGRATLTADKSTSTAYMELSSLRSEDTAVYYCARRGTGGWYFDVWGQGTTVTVSS

SEQ ID NO: 3136 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQELEWIGRIYPGDGDTKYNGKFKGRATLTADKSISTAYMELSSLRSEDTATYYCARRGTGGWYFDVWGQGTTVTVSS

SEQ ID NO: 3137 - protein, 119 aa, Artificial Sequence
  source: /note="Description of Artificial Sequence: Synthetic polypeptide"
EVQLVQSGAEVKKPGATVKISCKASGYAFSSSWMNWVQQAPGKGLEWIGRIYPGDGDTKYNGKFKGRATLTADKSTSTAYMELSSLRSEDTAVYYCARRGTGGWYFDVWGQGTTVTVSS

SEQ ID NO: 3138 - protein, 119 aa, Artificial Sequence
  source: /note="Description of Artificial Sequence: Synthetic polypeptide"
QVQLVQSGAEVKKTGSSVKVSCKASGYAFSSSWMNWVRQAPGQALEWIGRIYPGDGDTKYNGKFKGRATLTADKSMSTAYMELSSLRSEDTAMYYCARRGTGGWYFDVWGQGTTVTVSS

SEQ ID NO: 3139 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQRLEWIGRIYPGDGDTKYNGKFKGRATLTADKSASTAYMELSSLRSEDMAVYYCARRGTGGWYFDVWGQGTTVTVSS

SEQ ID NO: 3140 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQGLEWIGRIYPGDGDTKYNGKFKGRATLTADKSTSTAYMELRSLRSDDMAVYYCARRGTGGWYFDVWGQGTTVTVSS

SEQ ID NO: 3141 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQRLEWIGRIYPGDGDTKYNGKFKGRATLTADKSASTAYMELSSLRSEDTAVYYCARRGTGGWYFDVWGQGTTVTVSS

SEQ ID NO: 3142 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQGLEWIGRIYPGDGDTKYNGKFKGRATLTADKSTSTAYMELRSLRSDDTAVYYCARRGTGGWYFDVWGQGTTVTVSS

SEQ ID NO: 3143 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQGLEWIGRIYPGDGDTKYNGKFKGRATLTADKSISTAYMELSRLRSDDTAVYYCARRGTGGWYFDVWGQGTTVTVSS

SEQ ID NO: 3144 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQGLEWIGRIYPGDGDTKYNGKFKGRATLTADKSISTAYMELSRLRSDDTVVYYCARRGTGGWYFDVWGQGTTVTVSS

SEQ ID NO: 3145 - protein, 119 aa, Artificial Sequence
  source: /note="Description of Artificial Sequence: Synthetic polypeptide"
QVQLVQSGAEVKKPGASVKVSCKASGYAFSSSWMNWVRQAPGQGLEWIGRIYPGDGDTKYNGKFKGWATLTADKSISTAYMELSRLRSDDTAVYYCARRGTGGWYFDVWGQGTTVTVSS

SEQ ID NO: 3146 - protein, 119 aa, Artificial Sequence
  source: /note="Description of Artificial Sequence: Synthetic polypeptide"
QVQLVQSGAEVKKPGASVKVSCKASGYAFSSSWMNWVRQATGQGLEWIGRIYPGDGDTKYNGKFKGRATLTANKSISTAYMELSSLRSEDTAVYYCARRGTGGWYFDVWGQGTTVTVSS

SEQ ID NO: 3147 - protein, 119 aa, Artificial Sequence
  source: /note="Description of Artificial Sequence: Synthetic polypeptide"
QVQLVQSGSELKKPGASVKVSCKASGYAFSSSWMNWVRQAPGQGLEWIGRIYPGDGDTKYNGKFKGRAVLSADKSVSTAYLQISSLKAEDTAVYYCARRGTGGWYFDVWGQGTTVTVSS

SEQ ID NO: 3148 - protein, 119 aa, Artificial Sequence
  source: /note="Description of Artificial Sequence: Synthetic polypeptide"
QVQLVQSGPEVKKPGTSVKVSCKASGYAFSSSWMNWVRQARGQRLEWIGRIYPGDGDTKYNGKFKGRATLTADKSTSTAYMELSSLRSEDTAVYYCARRGTGGWYFDVWGQGTTVTVSS

SEQ ID NO: 3149 - protein, 119 aa, Artificial Sequence
  source: /note="Description of Artificial Sequence: Synthetic polypeptide"
EVQLVQSGAEVKKPGESLKISCKASGYAFSSSWMNWVRQMPGKGLEWIGRIYPGDGDTKYNGKFKGQATLSADKSISTAYLQWSSLKASDTAMYYCARRGTGGWYFDVWGQGTTVTVSS

SEQ ID NO: 3150 - protein, 119 aa, Artificial Sequence
  source: /note="Description of Artificial Sequence: Synthetic polypeptide"
QVQLVQSGSELKKPGASVKVSCKASGYAFSSSWMNWVRQAPGQGLEWIGRIYPGDGDTKYNGKFKGRAVLSADKSVSMAYLQISSLKAEDTAVYYCARRGTGGWYFDVWGQGTTVTVSS

SEQ ID NO: 3151 - protein, 119 aa, Artificial Sequence
  source: /note="Description of Artificial Sequence: Synthetic polypeptide"
QVQLVQSGHEVKQPGASVKVSCKASGYAFSSSWMNWVPQAPGQGLEWIGRIYPGDGDTKYNGKFKGRAVLSADKSASTAYLQISSLKAEDMAMYYCARRGTGGWYFDVWGQGTTVTVSS

SEQ ID NO: 3152 - protein, 119 aa, Artificial Sequence
  source: /note="Description of Artificial Sequence: Synthetic polypeptide"
EVQLVQSGAEVKKPGESLKISCKASGYAFSSSWMNWVRQMPGKGLEWIGRIYPGDGDTKYNGKFKGQATLSADKPISTAYLQWSSLKASDTAMYYCARRGTGGWYFDVWGQGTTVTVSS

SEQ ID NO: 3153 - protein, 119 aa, Artificial Sequence
  source: /note="Description of Artificial Sequence: Synthetic polypeptide"
EVQLVQSGAEVKKPGESLRISCKASGYAFSSSWMNWVRQMPGKGLEWIGRIYPGDGDTKYNGKFKGQATLSADKSISTAYLQWSSLKASDTAMYYCARRGTGGWYFDVWGQGTTVTVSS

SEQ ID NO: 3154 - protein, 119 aa, Artificial Sequence
  source: /note="Description of Artificial Sequence: Synthetic polypeptide"
EVQLVQSGAEVKKPGESLRISCKASGYAFSSSWMNWVRQMPGKGLEWIGRIYPGDGDTKYNGKFKGHATLSADKSISTAYLQWSSLKASDTAMYYCARRGTGGWYFDVWGQGTTVTVSS

SEQ ID NO: 3155 - protein, 119 aa, Artificial Sequence
  source: /note="Description of Artificial Sequence: Synthetic polypeptide"
QVQLVQSGAEVKKTGSSVKVSCKASGYAFSSSWMNWVRQAPRQALEWIGRIYPGDGDTKYNGKFKGRATLTADKSMSTAYMELSSLRSEDTAMYYCARRGTGGWYFDVWGQGTTVTVSS

SEQ ID NO: 3156 - protein, 119 aa, Artificial Sequence
  source: /note="Description of Artificial Sequence: Synthetic polypeptide"
EVQLVESGGGLVQPGRSLRLSCTASGYAFSSSWMNWVRQAPGKGLEWIGRIYPGDGDTKYNGKFKGRATLSADKSKSIAYLQMNSLKTEDTAVYYCARRGTGGWYFDVWGQGTTVTVSS

SEQ ID NO: 3157 - protein, 119 aa, Artificial Sequence
  source: /note="Description of Artificial Sequence: Synthetic polypeptide"
EVQLVESGGGLVQPGPSLRLSCTASGYAFSSSWMNWVRQAPGKGLEWIGRIYPGDGDTKYNGKFKGRATLSADKSKSIAYLQMNSLKTEDTAVYYCARRGTGGWYFDVWGQGTTVTVSS

SEQ ID NO: 3158 - protein, 119 aa, Artificial Sequence
  source: /note="Description of Artificial Sequence: Synthetic polypeptide"
QVQLQESGPGLVKPSQTLSLTCTASGYAFSSSWMNWVRQPPGKGLEWIGRIYPGDGDTKYNGKFKGRATLSADKSKSQASLKLSSVTAADTAVYYCARRGTGGWYFDVWGQGTTVTVSS

SEQ ID NO: 3159 - protein, 119 aa, Artificial Sequence
  source: /note="Description of Artificial Sequence: Synthetic polypeptide"
QVQLQESGPGLVKPSGTLSLTCAASGYAFSSSWMNWVRQPPGKGLEWIGRIYPGDGDTKYNGKFKGRATLSADKSKSQASLKLSSVTAADTAVYYCARRGTGGWYFDVWGQGTTVTVSS

SEQ ID NO: 3160 - protein, 119 aa, Artificial Sequence
  source: /note="Description of Artificial Sequence: Synthetic polypeptide"
EVQLVESGGGLVKPGRSLRLSCTASGYAFSSSWMNWVRQAPGKGLEWIGRIYPGDGDTKYNGKFKGRATLSADKSKSIAYLQMNSLKTEDTAVYYCARRGTGGWYFDVWGQGTTVTVSS

SEQ ID NO: 3161 - protein, 119 aa, Artificial Sequence
  source: /note="Description of Artificial Sequence: Synthetic polypeptide"
EVQLVESGGGLVQPGGSLKLSCAASGYAFSSSWMNWVRQASGKGLEWIGRIYPGDGDTKYNGKFKGRATLSADKSKSTAYLQMNSLKTEDTAVYYCARRGTGGWYFDVWGQGTTVTVSS

SEQ ID NO: 3162 - protein, 119 aa, Artificial Sequence
  source: /note="Description of Artificial Sequence: Synthetic polypeptide"
QVQLQESGPGLVKPSQTLSLTCAASGYAFSSSWMNWVRQPPGKGLEWIGRIYPGDGDTKYNGKFKGRATLSADKSKSQASLKLSSVTAADTAVYYCARRGTGGWYFDVWGQGTTVTVSS

SEQ ID NO: 3163 - protein, 119 aa, Artificial Sequence
  source: /note="Description of Artificial Sequence: Synthetic polypeptide"
EVQLVESGGGLVKPGGSLRLSCAASGYAFSSSWMNWVRQAPGKGLEWIGRIYPGDGDTKYNGKFKGRATLSADKSKSTAYLQMNSLKTEDTAVYYCARRGTGGWYFDVWGQGTTVTVSS

SEQ ID NO: 3164 - protein, 119 aa, Artificial Sequence
  source: /note="Description of Artificial Sequence: Synthetic polypeptide"
EVQLVESGGALVKPGGSLRLSCAASGYAFSSSWMNWVRQAPGKGLEWIGRIYPGDGDTKYNGKFKGRATLSADKSKSTAYLQMNSLKTEDTAVYYCARRGTGGWYFDVWGQGTTVTVSS

SEQ ID NO: 3165 - protein, 119 aa, Artificial Sequence
  source: /note="Description of Artificial Sequence: Synthetic polypeptide"
QVQLQESGPGLVKPSQTLSLTCAAYGYAFSSSWMNWVRQPPGKGLEWIGRIYPGDGDTKYNGKFKGRATLSADKSKSQASLKLSSVTAADTAVYYCARRGTGGWYFDVWGQGTTVTVSS

SEQ ID NO: 3166 - protein, 119 aa, Artificial Sequence
  source: /note="Description of Artificial Sequence: Synthetic polypeptide"
QVQLQESGSGLVKPSQTLSLTCAASGYAFSSSWMNWVRQPPGKGLEWIGRIYPGDGDTKYNGKFKGRATLSADKSKSQASLKLSSVTAADTAVYYCARRGTGGWYFDVWGQGTTVTVSS

SEQ ID NO: 3167 - protein, 119 aa, Artificial Sequence
  source: /note="Description of Artificial Sequence: Synthetic polypeptide"
EVQLVESGGGLVQPGGSLRLSCAASGYAFSSSWMNWVRQAPGKGLEWIGRIYPGDGDTKYNGKFKGRATLSADKSKSSAYLQMNSLKTEDTAVYYCARRGTGGWYFDVWGQGTTVTVSS

SEQ ID NO: 3168 - protein, 119 aa, Artificial Sequence
  source: /note="Description of Artificial Sequence: Synthetic polypeptide"
QVQLQESGPGLVKPSDTLSLTCTASGYAFSSSWMNWVRQPPGKGLEWIGRIYPGDGDTKYNGKFKGRATLSADKSKSQASLKLSSVTAADTAVYYCARRGTGGWYFDVWGQGTTVTVSS

SEQ ID NO: 3169 - protein, 119 aa, Artificial Sequence
  source: /note="Description of Artificial Sequence: Synthetic polypeptide"
QVQLQESGPGLVKPSQTLSLTCTASGYAFSSSWMNWVRQHPGKGLEWIGRIYPGDGDTKYNGKFKGRATLSADKSKSQASLKLSSVTAADTAVYYCARRGTGGWYFDVWGQGTTVTVSS

SEQ ID NO: 3170 - protein, 119 aa, Artificial Sequence
  source: /note="Description of Artificial Sequence: Synthetic polypeptide"
QVQLQESGPGLVKPSQTLSLTCTASGYAFSSSWMNWVRQHPGKGLEWIGRIYPGDGDTKYNGKFKGLATLSADKSKSQASLKLSSVTAADTAVYYCARRGTGGWYFDVWGQGTTVTVSS

SEQ ID NO: 3171 - protein, 119 aa, Artificial Sequence
  source: /note="Description of Artificial Sequence: Synthetic polypeptide"
QVQLVESGGGVVQPGRSLRLSCAASGYAFSSSWMNWVRQAPGKGLEWIGRIYPGDGDTKYNGKFKGRATLSADKSKSTAYLQMSSLRAEDTAVYYCARRGTGGWYFDVWGQGTTVTVSS

SEQ ID NO: 3172 - protein, 119 aa, Artificial Sequence
  source: /note="Description of Artificial Sequence: Synthetic polypeptide"
QVQLVESGGGLVKPGGSLRLSCAASGYAFSSSWMNWVRQAPGKGLEWIGRIYPGDGDTKYNGKFKGRATLSADKAKSSAYLQMNSLRAEDTAVYYCARRGTGGWYFDVWGQGTTVTVSS

SEQ ID NO: 3173 - protein, 119 aa, Artificial Sequence
  source: /note="Description of Artificial Sequence: Synthetic polypeptide"
QVQLVESGGGLVQPGGSLRLSCSASGYAFSSSWMNWVRQAPGKGLEWIGRIYPGDGDTKYNGKFKGRATLSADKSKSTAYLQMNSLRAEDTAVYYCARRGTGGWYFDVWGQGTTVTVSS

SEQ ID NO: 3174 - protein, 119 aa, Artificial Sequence
  source: /note="Description of Artificial Sequence: Synthetic polypeptide"
QVQLLESGGGLVKPGGSLRLSCAASGYAFSSSWMNWVRQAPGKGLEWIGRIYPGDGDTKYNGKFKGRATLSADKAKSSAYLQMNSLRAEDTAVYYCARRGTGGWYFDVWGQGTTVTVSS

SEQ ID NO: 3175 - protein, 119 aa, Artificial Sequence
  source: /note="Description of Artificial Sequence: Synthetic polypeptide"
EVQLVESGGGLVQPGGSLRLSCSASGYAFSSSWMNWVRQAPGKGLEWIGRIYPGDGDTKYNGKFKGRATLSADKSKSTAYLQMSSLRAEDTAVYYCARRGTGGWYFDVWGQGTTVTVSS

SEQ ID NO: 3176 - protein, 119 aa, Artificial Sequence
  source: /note="Description of Artificial Sequence: Synthetic polypeptide"
QVQLQESGPGLVKPSDTLSLTCAASGYAFSSSWMNWVRQPPGKGLEWIGRIYPGDGDTKYNGKFKGRATLSADKSKSQASLKLSSVTAVDTAVYYCARRGTGGWYFDVWGQGTTVTVSS

SEQ ID NO: 3177 - protein, 119 aa, Artificial Sequence
  source: /note="Description of Artificial Sequence: Synthetic polypeptide"
QVQLQESGPGLVKPSQTLSLTCAASGYAFSSSWMNWVRQPPGKGLEWIGRIYPGDGDTKYNGKFKGRATLSADKSKSQASLKLSSVTAVDTAVYYCARRGTGGWYFDVWGQGTTVTVSS

SEQ ID NO: 3178 - protein, 119 aa, Artificial Sequence
  source: /note="Description of Artificial Sequence: Synthetic polypeptide"
EVQLVESGGGLVQPGGSLRLSCSASGYAFSSSWMNWVRQAPGKGLEWIGRIYPGDGDTKYNGKFKGRATLSADKSKSTAYVQMSSLRAEDTAVYYCARRGTGGWYFDVWGQGTTVTVSS

SEQ ID NO: 3179 - protein, 119 aa, Artificial Sequence
  source: /note="Description of Artificial Sequence: Synthetic polypeptide"
QVQLVDSGGGVVQPGRSLRLSCAASGYAFSSSWMNWVRQAPGKGLEWIGRIYPGDGDTKYNGKFKGRATLSADKSKSTAYLQMNSLRAEDTAVYYCARRGTGGWYFDVWGQGTTVTVSS

SEQ ID NO: 3180 - protein, 119 aa, Artificial Sequence
  source: /note="Description of Artificial Sequence: Synthetic polypeptide"
QVQLVESGGGVVQPGRSLRLSCAASGYAFSSSWMNWVRQAPGKGLEWIGRIYPGDGDTKYNGKFKGRATLSADKSKSTAYLQMNSLRAEGTAVYYCARRGTGGWYFDVWGQGTTVTVSS

SEQ ID NO: 3181 - protein, 119 aa, Artificial Sequence
  source: /note="Description of Artificial Sequence: Synthetic polypeptide"
QVQLVESGGGVVQPGRSLRLSCAASGYAFSSSWMNWVRQAPGKGLEWIGRIYPGDGDTKYNGKFKGRATLSADKSKSTAYLQMNSLRAEDTAVYYCARRGTGGWYFDVWGQGTTVTVSS

SEQ ID NO: 3182 - protein, 119 aa, Artificial Sequence
  source: /note="Description of Artificial Sequence: Synthetic polypeptide"
EVQLVESGGGLVQPGGSLRLSCAASGYAFSSSWMNWVRQAPGKGLEWIGRIYPGDGDTKYNGKFKGRATLSADKSKSTAYLQMNSLRAEDTAVYYCARRGTGGWYFDVWGQGTTVTVSS

SEQ ID NO: 3183 - protein, 117 aa, Artificial Sequence
  source: /note="Description of Artificial Sequence: Synthetic polypeptide"
EVQLVESGGDLVKPGGSLKLSCAVSGFTFRSYGMSWVRQTPDKRLEWVALISSGGSYTYYTDSVKGRFTISRDNAKNTLYLQMSSLKSEDTAIYYCSRHGGNFFDYWGQGTTLTVSS

SEQ ID NO: 3184 - protein, 107 aa, Artificial Sequence
  source: /note="Description of Artificial Sequence: Synthetic polypeptide"
QIVLTQSPSIMSASPGEKVTMTCSVSSSVSYMHWYQQKSGTSPKRWIYDTSKLASGVPARFSGSGSGTSYSLTISSMEAEDAATYYCQQWSSNPQYTFGGGTKLEIK

SEQ ID NO: 3185 - protein, 107 aa, Artificial Sequence
  source: /note="Description of Artificial Sequence: Synthetic polypeptide"
DIVLTQSPAFLSVTPGEKVTITCSVSSSVSYMHWYQQKPDQAPKLLIYDTSKLASGVPSRFSGSGSGTDYTFTISSLEAEDAATYYCQQWSSNPQYTFGQGTKLEIK

SEQ ID NO: 3186 - protein, 107 aa, Artificial Sequence
  source: /note="Description of Artificial Sequence: Synthetic polypeptide"
AIQLTQSPSSLSASVGDRVTITCSVSSSVSYMHWYQQKPGKAPKLLIYDTSKLASGVPSRFSGSGSGTDYTLTISSLQPEDFATYYCQQWSSNPQYTFGQGTKLEIK

SEQ ID NO: 3187 - protein, 107 aa, Artificial Sequence
  source: /note="Description of Artificial Sequence: Synthetic polypeptide"
DIQLTQSPSFLSASVGDRVTITCSVSSSVSYMHWYQQKPGKAPKLLIYDTSKLASGVPSRFSGSGSGTEYTLTISSLQPEDFATYYCQQWSSNPQYTFGQGTKLEIK

SEQ ID NO: 3188 - protein, 107 aa, Artificial Sequence
  source: /note="Description of Artificial Sequence: Synthetic polypeptide"
DIQLTQSPSSLSASVGDRVTITCSVSSSVSYMHWYQQKPGKAPKLLIYDTSKLASGVPSRFSGSGSGTDYTLTISSLQPEDFATYYCQQWSSNPQYTFGQGTKLEIK

SEQ ID NO: 3189 - protein, 107 aa, Artificial Sequence
  source: /note="Description of Artificial Sequence: Synthetic polypeptide"
DIQLTQSPSSVSASVGDRVTITCSVSSSVSYMHWYQQKPGKAPKLLIYDTSKLASGVPSRFSGSGSGTDYTLTISSLQPEDFATYYCQQWSSNPQYTFGQGTKLEIK

SEQ ID NO: 3190 - protein, 107 aa, Artificial Sequence
  source: /note="Description of Artificial Sequence: Synthetic polypeptide"
DIQLTQSPSSLSASVGDRVTITCSVSSSVSYMHWYQQKPGKVPKLLIYDTSKLASGVPSRFSGSGSGTDYTLTISSLQPEDVATYYCQQWSSNPQYTFGQGTKLEIK

SEQ ID NO: 3191 - protein, 107 aa, Artificial Sequence
  source: /note="Description of Artificial Sequence: Synthetic polypeptide"
DIQLTQSPSSLSASVGDRVTITCSVSSSVSYMHWYQQKPGQAPKLLIYDTSKLASGVPSRFSGSGSGTDYTLTISSLQPEDVATYYCQQWSSNPQYTFGQGTKLEIK

SEQ ID NO: 3192 - protein, 107 aa, Artificial Sequence
  source: /note="Description of Artificial Sequence: Synthetic polypeptide"
EIVLTQSPDFQSVTPKEKVTITCSVSSSVSYMHWYQQKPDQSPKLLIYDTSKLASGVPSRFSGSGSGTDYTLTINSLEAEDAATYYCQQWSSNPQYTFGQGTKLEIK

SEQ ID NO: 3193 - protein, 107 aa, Artificial Sequence
  source: /note="Description of Artificial Sequence: Synthetic polypeptide"
AIRLTQSPFSLSASVGDRVTITCSVSSSVSYMHWYQQKPAKAPKLFIYDTSKLASGVPSRFSGSGSGTDYTLTISSLQPEDFATYYCQQWSSNPQYTFGQGTKLEIK

SEQ ID NO: 3194 - protein, 107 aa, Artificial Sequence
  source: /note="Description of Artificial Sequence: Synthetic polypeptide"
DIQLTQSPSSLSASVGDRVTITCSVSSSVSYMHWYQQKPGKAPKLLIYDTSKLASGVPSRFSGSGSGTDYTFTISSLQPEDIATYYCQQWSSNPQYTFGQGTKLEIK

SEQ ID NO: 3195 - protein, 107 aa, Artificial Sequence
  source: /note="Description of Artificial Sequence: Synthetic polypeptide"
EIVLTQSPATLSLSPGERATLSCSVSSSVSYMHWYQQKPGQAPKLLIYDTSKLASGIPARFSGSGSGTDYTLTISSLEPEDFAVYYCQQWSSNPQYTFGQGTKLEIK

SEQ ID NO: 3196 - protein, 107 aa, Artificial Sequence
  source: /note="Description of Artificial Sequence: Synthetic polypeptide"
DIQLTQSPSTLSASVGDRVTITCSVSSSVSYMHWYQQKPGKAPKLLIYDTSKLASGVPSRFSGSGSGTEYTLTISSLQPDDFATYYCQQWSSNPQYTFGQGTKLEIK

SEQ ID NO: 3197 - protein, 107 aa, Artificial Sequence
  source: /note="Description of Artificial Sequence: Synthetic polypeptide"
DIQLTQSPSSLSASVGDRVTITCSVSSSVSYMHWYQQKPGKTPKLLIYDTSKLASGIPSRFSGSGSGTDYTLTIRSLQPEDFATYYCQQWSSNPQYTFGQGTKLEIK

SEQ ID NO: 3198 - protein, 107 aa, Artificial Sequence
  source: /note="Description of Artificial Sequence: Synthetic polypeptide"
EIVLTQSPPTLSLSPGERVTLSCSVSSSVSYMHWYQQKPGQAPKLLIYDTSKLASGIPARFSGSGSGTDYTLTISSLQPEDFAVYYCQQWSSNPQYTFGQGTKLEIK

SEQ ID NO: 3199 - protein, 107 aa, Artificial Sequence
  source: /note="Description of Artificial Sequence: Synthetic polypeptide"
DIQLTQSPSSLSASVGDRVTITCSVSSSVSYMHWYQQKPGKAPKRLIYDTSKLASGVPSRFSGSGSGTEYTLTISSLQPEDFATYYCQQWSSNPQYTFGQGTKLEIK

SEQ ID NO: 3200 - protein, 107 aa, Artificial Sequence
  source: /note="Description of Artificial Sequence: Synthetic polypeptide"
EIVLTQSPATLSLSPGERATLSCSVSSSVSYMHWYQQKPGQAPKLLIYDTSKLASGIPARFSGSGPGTDYTLTISSLEPEDFAVYYCQQWSSNPQYTFGQGTKLEIK

SEQ ID NO: 3201 - protein, 107 aa, Artificial Sequence
  source: /note="Description of Artificial Sequence: Synthetic polypeptide"
EIVLTQSPATLSLSPGERATLSCSVSSSVSYMHWYQQKPGQAPKLLIYDTSKLASGIPARFSGSGSGTDYTLTISRLEPEDFAVYYCQQWSSNPQYTFGQGTKLEIK

SEQ ID NO: 3202 - protein, 107 aa, Artificial Sequence
  source: /note="Description of Artificial Sequence: Synthetic polypeptide"
EIVLTQSPATLSLSPGERATLSCSVSSSVSYMHWYQQKPGQAPKLLIYDTSKLASGIPARFSGSGSGTDYTLTISSLQPEDFAVYYCQQWSSNPQYTFGQGTKLEIK

SEQ ID NO: 3203 - protein, 107 aa, Artificial Sequence
  source: /note="Description of Artificial Sequence: Synthetic polypeptide"
EIVLTQSPATLSVSPGERATLSCSVSSSVSYMHWYQQKPGQAPKLLIYDTSKLASGIPARFSGSGSGTEYTLTISSLQSEDFAVYYCQQWSSNPQYTFGQGTKLEIK

SEQ ID NO: 3204 - protein, 107 aa, Artificial Sequence
  source: /note="Description of Artificial Sequence: Synthetic polypeptide"
EIVLTQSPATLSVSPGERATLSCSVSSSVSYMHWYQQKPGQAPKLLIYDTSKLASGIPARFSGSGSGTEYTLTISILQSEDFAVYYCQQWSSNPQYTFGQGTKLEIK

SEQ ID NO: 3205 - protein, 107 aa, Artificial Sequence
  source: /note="Description of Artificial Sequence: Synthetic polypeptide"
EIVLTQSPPTLSLSPGERVTLSCSVSSSVSYMHWYQQKPGQAPKLLIYDTSKLASSIPARFSGSGSGTDYTLTISSLQPEDFAVYYCQQWSSNPQYTFGQGTKLEIK

SEQ ID NO: 3206 - protein, 107 aa, Artificial Sequence
  source: /note="Description of Artificial Sequence: Synthetic polypeptide"
DIQLTQSPSSLSASVGDRVTITCSVSSSVSYMHWYQQKPGKAPKSLIYDTSKLASGVPSRFSGSGSGTDYTLTISSLQPEDFATYYCQQWSSNPQYTFGQGTKLEIK

SEQ ID NO: 3207 - protein, 107 aa, Artificial Sequence
  source: /note="Description of Artificial Sequence: Synthetic polypeptide"
DIQLTQSPSSLSASVGDRVTITCSVSSSVSYMHWYQQKPGKAPKRLIYDTSKLASGVPSRFSGSGSGTEYTLTISNLQPEDFATYYCQQWSSNPQYTFGQGTKLEIK

SEQ ID NO: 3208 - protein, 107 aa, Artificial Sequence
  source: /note="Description of Artificial Sequence: Synthetic polypeptide"
DIQLTQSPSAMSASVGDRVTITCSVSSSVSYMHWYQQKPGKVPKRLIYDTSKLASGVPSRFSGSGSGTEYTLTISSLQPEDFATYYCQQWSSNPQYTFGQGTKLEIK

SEQ ID NO: 3209 - protein, 107 aa, Artificial Sequence
  source: /note="Description of Artificial Sequence: Synthetic polypeptide"
EIVLTQSPATLSLSPGERATLSCSVSSSVSYMHWYQQKPGQAPKLLIYDTSKLASGIPDRFSGSGSGTDYTLTISRLEPEDFAVYYCQQWSSNPQYTFGQGTKLEIK

SEQ ID NO: 3210 - protein, 107 aa, Artificial Sequence
  source: /note="Description of Artificial Sequence: Synthetic polypeptide"
EIVLTQSPATLSLSPGERATLSCSVSSSVSYMHWYQQKPGLAPKLLIYDTSKLASGIPDRFSGSGSGTDYTLTISRLEPEDFAVYYCQQWSSNPQYTFGQGTKLEIK

SEQ ID NO: 3211 - protein, 107 aa, Artificial Sequence
  source: /note="Description of Artificial Sequence: Synthetic polypeptide"
EIVLTQSPGTLSLSPGERATLSCSVSSSVSYMHWYQQKPGQAPKLLIYDTSKLASGIPDRFSGSGSGTDYTLTISRLEPEDFAVYYCQQWSSNPQYTFGQGTKLEIK

SEQ ID NO: 3212 - protein, 107 aa, Artificial Sequence
  source: /note="Description of Artificial Sequence: Synthetic polypeptide"
DIQLTQSPSSLSASVGDRVTITCSVSSSVSYMHWYQQKPGKAPKSLIYDTSKLASGVPSKFSGSGSGTDYTLTISSLQPEDFATYYCQQWSSNPQYTFGQGTKLEIK

SEQ ID NO: 3213 - protein, 107 aa, Artificial Sequence
  source: /note="Description of Artificial Sequence: Synthetic polypeptide"
DIQLTQSPSSLSASVGDRVTITCSVSSSVSYMHWYQQKPEKAPKSLIYDTSKLASGVPSRFSGSGSGTDYTLTISSLQPEDFATYYCQQWSSNPQYTFGQGTKLEIK

SEQ ID NO: 3214 - protein, 107 aa, Artificial Sequence
  source: /note="Description of Artificial Sequence: Synthetic polypeptide"
DIVLTQSPDSLAVSLGERATINCSVSSSVSYMHWYQQKPGQPPKLLIYDTSKLASGVPDRFSGSGSGTDYTLTISSLQAEDVAVYYCQQWSSNPQYTFGQGTKLEIK

SEQ ID NO: 3215 - protein, 107 aa, Artificial Sequence
  source: /note="Description of Artificial Sequence: Synthetic polypeptide"
EIVLTQTPLSLSITPGEQASMSCSVSSSVSYMHWYLQKARPVPKLLIYDTSKLASGVPDRFSGSGSGTDYTLKISRVEAEDFGVYYCQQWSSNPQYTFGQGTKLEIK

SEQ ID NO: 3216 - protein, 107 aa, Artificial Sequence
  source: /note="Description of Artificial Sequence: Synthetic polypeptide"
EIVLTQTPLSLSITPGEQASISCSVSSSVSYMHWYLQKARPVPKLLIYDTSKLASGVPDRFSGSGSGTDYTLKISRVEAEDFGVYYCQQWSSNPQYTFGQGTKLEIK

SEQ ID NO: 3217 - protein, 107 aa, Artificial Sequence
  source: /note="Description of Artificial Sequence: Synthetic polypeptide"
DIVLTQSPLSLPVTPGEPASISCSVSSSVSYMHWYLQKPGQSPKLLIYDTSKLASGVPDRFSGSGSGTDYTLKISRVEAEDVGVYYCQQWSSNPQYTFGQGTKLEIK

SEQ ID NO: 3218 - protein, 107 aa, Artificial Sequence
  source: /note="Description of Artificial Sequence: Synthetic polypeptide"
DIVLTQSPLSLPVTLGQPASISCSVSSSVSYMHWYQQRPGQSPKRLIYDTSKLASGVPDRFSGSGSGTDYTLKISRVEAEDVGVYYCQQWSSNPQYTFGQGTKLEIK

SEQ ID NO: 3219 - protein, 107 aa, Artificial Sequence
  source: /note="Description of Artificial Sequence: Synthetic polypeptide"
DIVLTQTPLSLPVTPGEPASISCSVSSSVSYMHWYLQKPGQSPKLLIYDTSKLASGVPDRFSGSGSGTDYTLKISRVEAEDVGVYYCQQWSSNPQYTFGQGTKLEIK

SEQ ID NO: 3220 - protein, 107 aa, Artificial Sequence
  source: /note="Description of Artificial Sequence: Synthetic polypeptide"
DIVLTQTPLSLSVTPGQPASISCSVSSSVSYMHWYLQKPGQSPKLLIYDTSKLASGVPDRFSGSGSGTDYTLKISRVEAEDVGVYYCQQWSSNPQYTFGQGTKLEIK

SEQ ID NO: 3221 - protein, 107 aa, Artificial Sequence
  source: /note="Description of Artificial Sequence: Synthetic polypeptide"
DIVLTQTPLSLSVTPGQPASISCSVSSSVSYMHWYLQKPGQPPKLLIYDTSKLASGVPDRFSGSGSGTDYTLKISRVEAEDVGVYYCQQWSSNPQYTFGQGTKLEIK

SEQ ID NO: 3222 - protein, 107 aa, Artificial Sequence
  source: /note="Description of Artificial Sequence: Synthetic polypeptide"
DIQLIQSPSFLSASVGDRVSIICSVSSSVSYMHWYLQKPGKSPKLFIYDTSKLASGVSSRFSGRGSGTDYTLTIISLKPEDFAAYYCQQWSSNPQYTFGQGTKLEIK

SEQ ID NO: 3223 - protein, 107 aa, Artificial Sequence
  source: /note="Description of Artificial Sequence: Synthetic polypeptide"
DIVLTQTPLSSPVTLGQPASISCSVSSSVSYMHWYQQRPGQPPKLLIYDTSKLASGVPDRFSGSGAGTDYTLKISRVEAEDVGVYYCQQWSSNPQYTFGQGTKLEIK

SEQ ID NO: 3224 - protein, 107 aa, Artificial Sequence
  source: /note="Description of Artificial Sequence: Synthetic polypeptide"
EITLTQSPAFMSATPGDKVNISCSVSSSVSYMHWYQQKPGEAPKFIIYDTSKLASGIPPRFSGSGYGTDYTLTINNIESEDAAYYYCQQWSSNPQYTFGQGTKLEIK

SEQ ID NO: 3225 - protein, 117 aa, Artificial Sequence
  source: /note="Description of Artificial Sequence: Synthetic polypeptide"
EVQLVESGGGLVKPGGSLRLSCAVSGFTFRSYGMSWVRQAPGKGLEWVALISSGGSYTYYTDSVKGRFTISRDNSKNTLYLQMNSLKTEDTAVYYCSRHGGNFFDYWGQGTTVTVSS

SEQ ID NO: 3226 - protein, 117 aa, Artificial Sequence
  source: /note="Description of Artificial Sequence: Synthetic polypeptide"
EVQLVESGGALVKPGGSLRLSCAVSGFTFRSYGMSWVRQAPGKGLEWVALISSGGSYTYYTDSVKGRFTISRDNSKNTLYLQMNSLKTEDTAVYYCSRHGGNFFDYWGQGTTVTVSS

SEQ ID NO: 3227 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNAKNTLYLQMNSLRAEDTAVYYCSRHGGNFFDYWGQGTTVTVSS

SEQ ID NO: 3228 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS

SEQ ID NO: 3229 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNSKNSLYLQMNSLKTEDTAVYYCSRHGGNFFDYWGQGTTVTVSS

SEQ ID NO: 3230 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNAKNSLYLQMNSLRAEDMAVYYCSRHGGNFFDYWGQGTTVTVSS

SEQ ID NO: 3231 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGQFTISRDNAKNTLYLQMNSLRAEDMAVYYCSRHGGNFFDYWGQGTTVTVSS

SEQ ID NO: 3232 - protein, 117 aa, Artificial Sequence
  source: /note="Description of Artificial Sequence: Synthetic polypeptide"
EVQLVESGGGLVKPGRSLRLSCTVSGFTFRSYGMSWVRQAPGKGLEWVALISSGGSYTYYTDSVKGRFTISRDNSKNILYLQMNSLKTEDTAVYYCSRHGGNFFDYWGQGTTVTVSS

SEQ ID NO: 3233 - protein, 117 aa, Artificial Sequence
  source: /note="Description of Artificial Sequence: Synthetic polypeptide"
EVQLVESGGGLVKPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS

SEQ ID NO: 3234 - protein, 117 aa, Artificial Sequence
  source: /note="Description of Artificial Sequence: Synthetic polypeptide"
EVQLVESGGGLVQPGGSLKLSCAVSGFTFRSYGMSWVRQASGKGLEWVALISSGGSYTYYTDSVKGRFTISRDNSKNTLYLQMNSLKTEDTAVYYCSRHGGNFFDYWGQGTTVTVSS

SEQ ID NO: 3235 - protein, 117 aa, Artificial Sequence
  source: /note="Description of Artificial Sequence: Synthetic polypeptide"
QVQLVESGGGVVQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3236 - protein, 117 aa, Artificial Sequence
  source: /note="Description of Artificial Sequence: Synthetic polypeptide"
QVQLVESGGGVVQPGRSLRLSCAVSGFTFRSYGMSWVRQAPGKGLEWVALISSGGSYTYYTDSVKGRFTISRDNSKNTLYLQMSSLRAEDTAVYYCSRHGGNFFDYWGQGTTVTVSS

SEQ ID NO: 3237 - protein, 117 aa, Artificial Sequence
  source: /note="Description of Artificial Sequence: Synthetic polypeptide"
EVQLVESGGGLVQPGGSLRLSCPVSGFTFRSYGMSWVRQAPGKGLEWVALISSGGSYTYYTDSVKGRFTISRDNANNSLYLQMNSLRAEDTAVYYCSRHGGNFFDYWGQGTTVTVSS

SEQ ID NO: 3238 - protein, 117 aa, Artificial Sequence
  source: /note="Description of Artificial Sequence: Synthetic polypeptide"
EVQLVESGGGLVQPGRSLRLSCTVSGFTFRSYGMSWVRQAPGKGLEWVALISSGGSYTYYTDSVKGRFTISRDNSKNILYLQMNSLKTEDTAVYYCSRHGGNFFDYWGQGTTVTVSS

SEQ ID NO: 3239 - protein, 117 aa, Artificial Sequence
  source: /note="Description of Artificial Sequence: Synthetic polypeptide"
EVQLVESGGGLVQPGPSLRLSCTVSGFTFRSYGMSWVRQAPGKGLEWVALISSGGSYTYYTDSVKGRFTISRDNSKNILYLQMNSLKTEDTAVYYCSRHGGNFFDYWGQGTTVTVSS

SEQ ID NO: 3240 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3241 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNAKNSLYLQMNSLRDEDTAVYYCSRHGGNFFDYWGQGTTVTVSS

SEQ ID NO: 3242 - protein, 117 aa, Artificial Sequence
  source: /note="Description of Artificial Sequence: Synthetic polypeptide"
QVQLVESGGGLVKPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS

SEQ ID NO: 3243 - protein, 117 aa, Artificial Sequence
  source: /note="Description of Artificial Sequence: Synthetic polypeptide"
QVQLVESGGGVVQPGRSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3244 - protein, 117 aa, Artificial Sequence
  source: /note="Description of Artificial Sequence: Synthetic polypeptide"
EVQLLESGGGLVQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3245 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRHNSKNTLYLQMNSLRAEDTAVYYCSRHGGNFFDYWGQGTTVTVSS

SEQ ID NO: 3246 - protein, 117 aa, Artificial Sequence
  source: /note="Description of Artificial Sequence: Synthetic polypeptide"
EVQLVESGGGLIQPGGSLRLSCAVSGFTFRSYGMSWVRQPPGKGLEWVALISSGGSYTYYTDSVKGRFTISRDNSKNTLYLQMNSLRAEDTAVYYCSRHGGNFFDYWGQGTTVTVSS

SEQ ID NO: 3247 - protein, 117 aa, Artificial Sequence
  source: /note="Description of Artificial Sequence: Synthetic polypeptide"
EVQLVESGGGLIQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3248 - protein, 117 aa, Artificial Sequence
  source: /note="Description of Artificial Sequence: Synthetic polypeptide"
EVQLVESGGGLVQPGRSLRLSCAVSGFTFRSYGMSWVRQAPGKGLEWVALISSGGSYTYYTDSVKGRFTISRDNAKNSLYLQMNSLRAEDTALYYCSRHGGNFFDYWGQGTTVTVSS

SEQ ID NO: 3249 - protein, 117 aa, Artificial Sequence
  source: /note="Description of Artificial Sequence: Synthetic polypeptide"
QVQLVESGGGVVQPGRSLRLSCAVSGFTFRSYGMSWVRQAPGKGLEWVALISSGGSYTYYTDSVKGRFTISRDNSKNRLYLQMNSLRAEDTAVYYCSRHGGNFFDYWGQGTTVTVSS

SEQ ID NO: 3250 - protein, 117 aa, Artificial Sequence
  source: /note="Description of Artificial Sequence: Synthetic polypeptide"
QVQLVESGGGVVQPGRSLRLSCAVSGFTFRSYGMSWVRQAPGKGLEWVALISSGGSYTYYTDSVKGRFTISRDNSKNTLYLQMNSLRAEGTAVYYCSRHGGNFFDYWGQGTTVTVSS

SEQ ID NO: 3251 - protein, 117 aa, Artificial Sequence
  source: /note="Description of Artificial Sequence: Synthetic polypeptide"
QVQLVESGGGVVQPGRSLRLSCAVSGFTFRSYGMSWVRQAPGKGLEWVALISSGGSYTYYTDSVKGRFAISRDNSKNTLYLQMNSLRAEDTAVYYCSRHGGNFFDYWGQGTTVTVSS

SEQ ID NO: 3252 - protein, 117 aa, Artificial Sequence
  source: /note="Description of Artificial Sequence: Synthetic polypeptide"
QVQLVDSGGGVVQPGRSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3253 - protein, 117 aa, Artificial Sequence
  source: /note="Description of Artificial Sequence: Synthetic polypeptide"
EVQLVESGGGVVRPGGSLRLSCAVSGFTFRSYGMSWVRQAPGKGLEWVALISSGGSYTYYTDSVKGRFTISRDNAKNSLYLQMNSLRAEDTALYHCSRHGGNFFDYWGQGTTVTVSS

SEQ ID NO: 3254 - protein, 117 aa, Artificial Sequence
  source: /note="Description of Artificial Sequence: Synthetic polypeptide"
EVQLVESGGVVVQPGGSLRLSCAVSGFTFRSYGMSWVRQAPGKGLEWVALISSGGSYTYYTDSVKGRFTISRDNSKNSLYLQMNSLRAEDTALYYCSRHGGNFFDYWGQGTTVTVSS

SEQ ID NO: 3255 - protein, 117 aa, Artificial Sequence
  source: /note="Description of Artificial Sequence: Synthetic polypeptide"
EVQLVESGGGVVQPGGSLRLSCAVSGFTFRSYGMSWVRQAPGKGLEWVALISSGGSYTYYTDSVKGRFTISRDNSKNSLYLQMNSLRTEDTALYYCSRHGGNFFDYWGQGTTVTVSS

SEQ ID NO: 3256 - protein, 117 aa, Artificial Sequence
  source: /note="Description of Artificial Sequence: Synthetic polypeptide"
EVQLVESGGVVVQPGGSLRLSCAVSGFTFRSYGMSWVRQAPGKGLEWVALISSGGSYTYYTDSVKGRFTISRDNSKNSLYLQMNSLRTEDTALYYCSRHGGNFFDYWGQGTTVTVSS

SEQ ID NO: 3257 - protein, 117 aa, Artificial Sequence
  source: /note="Description of Artificial Sequence: Synthetic polypeptide"
EVQLVETGGGLIQPGGSLRLSCAVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3258 - protein, 117 aa, Artificial Sequence
  source: /note="Description of Artificial Sequence: Synthetic polypeptide"
EVQLVESGGGLVQPGGSLRLSCAVSGFTFRSYGMSWVRQATGKGLEWVALISSGGSYTYYTDSVKGRFTISRENAKNSLYLQMNSLRAGDTAVYYCSRHGGNFFDYWGQGTTVTVSS

SEQ ID NO: 3259 - protein, 117 aa, Artificial Sequence
  source: /note="Description of Artificial Sequence: Synthetic polypeptide"
EVQLVESRGVLVQPGGSLRLSCAVSGFTFRSYGMSWVRQAPGKGLEWVALISSGGSYTYYTDSVKGRFTISRDNSKNTLHLQMNSLRAEDTAVYYCSRHGGNFFDYWGQGTTVTVSS

SEQ ID NO: 3260 - protein, 117 aa, Artificial Sequence
  source: /note="Description of Artificial Sequence: Synthetic polypeptide"
EVQLVESGGGLVQPGRSLRLSCAVSGFTFRSYGMSWVRQAPGKGLEWVALISSGGSYTYYTDSVKGRFTISRDNAKNSLYLQMNSLRAEDMALYYCSRHGGNFFDYWGQGTTVTVSS

SEQ ID NO: 3261 - protein, 117 aa, Artificial Sequence
  source: /note="Description of Artificial Sequence: Synthetic polypeptide"
QVQLVESGGGLVQPGGSLRLSCSVSGFTFRSYGMSWVRQAPGKGLEWVALISSGGSYTYYTDSVKGRFTISRDNSKNTLYLQMNSLRAEDTAVYYCSRHGGNFFDYWGQGTTVTVSS

SEQ ID NO: 3262 - protein, 117 aa, Artificial Sequence
  source: /note="Description of Artificial Sequence: Synthetic polypeptide"
EVQLVESGGGLVQPGGSLRLSCSVSGFTFRSYGMSWVRQAPGKGLEWVALISSGGSYTYYTDSVKGRFTISRDNSKNTLYLQMSSLRAEDTAVYYCSRHGGNFFDYWGQGTTVTVSS

SEQ ID NO: 3263 - protein, 117 aa, Artificial Sequence
  source: /note="Description of Artificial Sequence: Synthetic polypeptide"
QVQLVESGGGVVQPGRSLRLSCAVSGFTFRSYGMSWVRQAPGKGLEWVALISSGGSYTYYTDSVKGRFTISRDNSTNTLFLQMNSLRAEDTAVYYCSRHGGNFFDYWGQGTTVTVSS

SEQ ID NO: 3264 - protein, 117 aa, Artificial Sequence
  source: /note="Description of Artificial Sequence: Synthetic polypeptide"
QVQLLESGGGLVKPGGSLRLSCAVSGFTFRSYGMSWVRQAPGKGLEWVALISSGGSYTYYTDSVKGRFTISRDNAKNSLYLQMNSLRAEDTAVYYCSRHGGNFFDYWGQGTTVTVSS

SEQ ID NO: 3265 - protein, 117 aa, Artificial Sequence
  source: /note="Description of Artificial Sequence: Synthetic polypeptide"
EVQLVESGEGLVQPGGSLRLSCAVSGFTFRSYGMSWVRQAPGKGLEWVALISSGGSYTYYTDSVKGRFTISRDNSKNTLYLQMGSLRAEDMAVYYCSRHGGNFFDYWGQGTTVTVSS

SEQ ID NO: 3266 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFTISRDNSKNTLYLQMGSLRAEDMAVYYCSRHGGNFFDYWGQGTTVTVSS

SEQ ID NO: 3267 - protein, 117 aa, Artificial Sequence
  source: /note="Description of Artificial Sequence: Synthetic polypeptide"
EVQLVESGGGLVQPGGSLRLSCSVSGFTFRSYGMSWVRQAPGKGLEWVALISSGGSYTYYTDSVKGRFTISRDNSKNTLYVQMSSLRAEDTAVYYCSRHGGNFFDYWGQGTTVTVSS

SEQ ID NO: 3268 - protein, 117 aa, Artificial Sequence
  source: /note="Description of Artificial Sequence: Synthetic polypeptide"
EVQLVESGGGLVQPGGSLRLSCAVSGFTFRSYGMSWVRQAPGKGLEWVALISSGGSYTYYTDSVKGRFIISRDNSRNSLYLQKNRRRAEDMAVYYCSRHGGNFFDYWGQGTTVTVSS

SEQ ID NO: 3269 - protein, 117 aa, Artificial Sequence
  source: /note="Description of Artificial Sequence: Synthetic polypeptide"
EVQLVESGGGLVQPGGSLRLSCAVSGFTFRSYGMSWVHQAPGKGLEWVALISSGGSYTYYTDSVKGRFIISRDNSRNTLYLQTNSLRAEDTAVYYCSRHGGNFFDYWGQGTTVTVSS

SEQ ID NO: 3270 - protein, 117 aa, Artificial Sequence
  source: /note="Description of Artificial Sequence: Synthetic polypeptide"
EVHLVESGGGLVQPGGALRLSCAVSGFTFRSYGMSWVRQATGKGLEWVALISSGGSYTYYTDSVKGRFTISRENAKNSLYLQMNSLRAGDTAVYYCSRHGGNFFDYWGQGTTVTVSS

SEQ ID NO: 3271 - protein, 117 aa, Artificial Sequence
  source: /note="Description of Artificial Sequence: Synthetic polypeptide"
EVQLVESGGGLVQPRGSLRLSCAVSGFTFRSYGMSWVRQAPGKGLEWVALISSGGSYTYYTDSVKGRFTISRDNSKNTLYLQMNNLRAEGTAVYYCSRHGGNFFDYWGQGTTVTVSS

SEQ ID NO: 3272 - protein, 117 aa, Artificial Sequence
  source: /note="Description of Artificial Sequence: Synthetic polypeptide"
EVQLVESGGGLVQPRGSLRLSCAVSGFTFRSYGMSWVRQAPGKGLEWVALISSGGSYTYYTDSVKGRFTISRDNSKNTLYLQMNNLRAEGTAAYYCSRHGGNFFDYWGQGTTVTVSS

SEQ ID NO: 3273 - protein, 117 aa, Artificial Sequence
  source: /note="Description of Artificial Sequence: Synthetic polypeptide"
QVQLVQSGAEVKKPGASVKVSCKVSGFTFRSYGMSWVRQAPGKGLEWVALISSGGSYTYYTDSVKGRFTITRDNSTNTLYMELSSLRSEDTAVYYCSRHGGNFFDYWGQGTTVTVSS

SEQ ID NO: 3274 - protein, 117 aa, Artificial Sequence
  source: /note="Description of Artificial Sequence: Synthetic polypeptide"
QVQLVQSGSELKKPGASVKVSCKVSGFTFRSYGMSWVRQAPGQGLEWVALISSGGSYTYYTDSVKGRFVISRDNSVNTLYLQISSLKAEDTAVYYCSRHGGNFFDYWGQGTTVTVSS

SEQ ID NO: 3275 - protein, 470 aa, Artificial Sequence
  source: /note="Description of Artificial Sequence: Synthetic polypeptide"
METDTLLLWVLLLWVPGSTGQVQLVESGGGVVQPGRSLRLSCAASGIDFSRYWMSWVRQAPGKGLEWVGEINPDSSTINYAPSLKDRFTISRDNSKNTLYLQMSSLRAEDTAVYYCASLYYDYGDAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3276 - protein, 503 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSGGGGSGGGGSGGGGSGGGGSDIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIKGGGGSGGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 3277 - protein, 234 aa, Artificial Sequence; identical to SEQ ID NO: 1007
  source: /note="Description of Artificial Sequence: Synthetic polypeptide"

SEQ ID NO: 3278 - protein, 469 aa, Artificial Sequence
  source: /note="Description of Artificial Sequence: Synthetic polypeptide"
METDTLLLWVLLLWVPGSTGQVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3279 - protein, 234 aa, Artificial Sequence
  source: /note="Description of Artificial Sequence: Synthetic polypeptide"
METDTLLLWVLLLWVPGSTGDIQMTQSPSSLSASVGDRVTITCKASQNVGINVVWHQQKPGKVPKALIYSSSHRYSGVPSRFSGSGSGTDFTLTISSLQPEDVATYFCQQFKSYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3280 - protein, 247 aa, Artificial Sequence
  source: /note="Description of Artificial Sequence: Synthetic polypeptide"
METDTLLLWVLLLWVPGSTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRFTQKSLSLSPGK

SEQ ID NO: 3281 - protein, 520 aa, Artificial Sequence
  source: /note="Description of Artificial Sequence: Synthetic polypeptide"
METDTLLLWVLLLWVPGSTGEVQLVESGGGLVQPGGSLRLSCAASGFTFSNFGMHWVRQAPGKGLEWVSYISSGSSTIYYADTLKGRFTISRDNSKNTLYLQMNSLRAEDTAVYYCARRGEGAMDYWGQGTTVTVSSGGGGSGGGGSGGGGSGGGGSDNQLTQSPSFLSASVGDRVTITCRASSSVNYIYWYQQKPGKAPKLLIYYTSNLAPGVPSRFSGSGSGNEYTLTISSLQPEDFATYYCQQFTSSPFTFGQGTKLEIKGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGLNDIFEAQKIEWHE

SEQ ID NO: 3282 - protein, 284 aa, Artificial Sequence
  source: /note="Description of Artificial Sequence: Synthetic polypeptide"
METDTLLLWVLLLWVPGSTGGLNDIFEAQKIEWHEGGGGSEPRTDTDTCPNPPDPCPTCPTPDLLGGPSVFIFPPKPKDVLMISLTPKITCVVVDVSEEEPDVQFNWYVNNVEDKTAQTETRQRQYNSTYRVVSVLPIKHQDWMSGKVFKCKVNNNALPSPIEKTISKPRGQVRVPQIYTFPPPIEQTVKKDVSVTCLVTGFLPQDIHVEWESNGQPQPEQNYKNTQPVLDSDGSYFLYSKLNVPKSRWDQGDSFTCSVIHEALHNHHMTKTISRSLGNGGGGS

SEQ ID NO: 3283 - protein, 272 aa, Artificial Sequence
  source: /note="Description of Artificial Sequence: Synthetic polypeptide"
METDTLLLWVLLLWVPGSTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGLNDIFEAQKIEWHE

SEQ ID NO: 3284 - protein, 469 aa, Artificial Sequence
  source: /note="Description of Artificial Sequence: Synthetic polypeptide"
METDTLLLWVLLLWVPGSTGQVQLQQSGPELVKPGASVKISCKASGYAFSSSWMNWVKQRPGQGLEWIGRIYPGDGDTKYNGKFKGKATLTADKSSSTAYMHLSSLTSVDSAVYFCARRGTGGWYFDVWGAGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 3285 - protein, 238 aa, Artificial Sequence
  source: /note="Description of Artificial Sequence: Synthetic polypeptide"
METDTLLLWVLLLWVPGSTGDIVLTQSPASLAVSLGQRATISCRASESVDSSGNSFMHWYQQKPGQPPQLLIYRASNLESGIPARFSGSGSRTDFTLTINPVEADDVATFYCQQSFDDPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3286 - protein, 739 aa, Artificial Sequence
  source: /note="Description of Artificial Sequence: Synthetic polypeptide"
METDTLLLWVLLLWVPGSTGQVQLVESGGGVVQPGRSLRLSCAASGIDFSRYWMSWVRQAPGKGLEWVGEINPDSSTINYAPSLKDRFTISRDNSKNTLYLQMSSLRAEDTAVYYCASLYYDYGDAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSEVQLVESGGGLVQPGGSLRLSCAASGFTFSTYAMNWVRQAPGKGLEWVSRIRSKYNNYATYYADSVKDRFTISRDDSKNTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGGKAALTLSGAQPEDEAEYYCALWYSNLWVFGGGTKLTVL

SEQ ID NO: 3287 - protein, 247 aa, Artificial Sequence
  source: /note="Description of Artificial Sequence: Synthetic polypeptide"
METDTLLLWVLLLWVPGSTGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 3288 - protein, 20 aa, Artificial Sequence
  source: /note="Description of Artificial Sequence: Synthetic peptide"
METDTLLLWVLLLWVPGSTG

SEQ ID NO: 3289 - protein, 107 aa, Artificial Sequence; identical to SEQ ID NO: 108
  source: /note="Description of Artificial Sequence: Synthetic polypeptide"
  VARIANT (30)..(30): /replace="Glu" or "Ala" or "Asp"
  VARIANT (31)..(31): /replace="Asp"
  VARIANT (32)..(32): /replace="Lys"
  VARIANT (36)..(36): /replace="His"
  VARIANT (56)..(56): /replace="Ser"
  SITE (1)..(107): /note="Variant residues given in the sequence have no preference with respect to those in the annotations for variant positions"

SEQ ID NO: 3290 - protein, 119 aa, Artificial Sequence; identical to SEQ ID NO: 148
  source: /note="Description of Artificial Sequence: Synthetic polypeptide"
  VARIANT (27)..(27): /replace="Thr" or "Gly" or "Tyr"
  VARIANT (28)..(28): /replace="Thr" or "Ser"
  VARIANT (30)..(30): /replace="Asp" or "Lys" or "Thr"
  VARIANT (31)..(31): /replace="Asp" or "Lys" or "Thr" or "Asn"
  VARIANT (32)..(32): /replace="Phe" or "Thr" or "Ile" or "Tyr" or "Gly"
  VARIANT (50)..(50): /replace="Trp"
  VARIANT (51)..(51): /replace="Ile" or "Phe"
  VARIANT (52)..(52): /replace="Ser" or "Tyr"
  VARIANT (53)..(53): /replace="Pro"
  VARIANT (57)..(57): /replace="Ser"
  VARIANT (58)..(58): /replace="Val" or "Tyr" or "Ile"
  VARIANT (59)..(59): /replace="Arg"
  VARIANT (98)..(98): /replace="Val"
  VARIANT (100)..(100): /replace="Ile"
  VARIANT (103)..(103): /replace="Ala"
  VARIANT (104)..(104): /replace="Asp"
  SITE (1)..(119): /note="Variant residues given in the sequence have no preference with respect to those in the annotations for variant positions"

SEQ ID NO: 3291 - protein, 238 aa, Artificial Sequence
  source: /note="Description of Artificial Sequence: Synthetic polypeptide"
DLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFS

SEQ ID NO: 3292 - protein, 284 aa, Artificial Sequence
  source: /note="Description of Artificial Sequence: Synthetic polypeptide"
EPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 3293 - protein, 287 aa, Artificial Sequence
  source: /note="Description of Artificial Sequence: Synthetic polypeptide"
AEPHSLRYNLMVLSQDESVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKVLVLQSQRTD

SEQ ID NO: 3294 - protein, 191 aa, Artificial Sequence
  source: /note="Description of Artificial Sequence: Synthetic polypeptide"
GWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPG

SEQ ID NO: 3295 - protein, 329 aa, Artificial Sequence
  source: /note="Description of Artificial Sequence: Synthetic polypeptide"
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 3296 - protein, 323 aa, Artificial Sequence
  source: /note="Description of Artificial Sequence: Synthetic polypeptide"
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 3297 - protein, 330 aa, Artificial Sequence
  source: /note="Description of Artificial Sequence: Synthetic polypeptide"
QNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDH

SEQ ID NO: 3298 - protein, 155 aa, Artificial Sequence
  source: /note="Description of Artificial Sequence: Synthetic polypeptide"
QRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 3299 - protein, 294 aa, Artificial Sequence
  source: /note="Description of Artificial Sequence: Synthetic polypeptide"
WTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYN

SEQ ID NO: 3300 - protein, 243 aa, Artificial Sequence
  source: /note="Description of Artificial Sequence: Synthetic polypeptide"
RYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 3301 - protein, 124 aa, Artificial Sequence
  source: /note="Description of Artificial Sequence: Synthetic polypeptide"
KLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 3302 - protein, 194 aa, Artificial Sequence
  source: /note="Description of Artificial Sequence: Synthetic polypeptide"
QGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARS

SEQ ID NO: 3303 - protein, 133 aa, Artificial Sequence
  source: /note="Description of Artificial Sequence: Synthetic polypeptide"
QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 3304 - protein, 149 aa, Artificial Sequence
  source: /note="Description of Artificial Sequence: Synthetic polypeptide"
MQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 3305 - protein, 205 aa, Artificial Sequence
  source: /note="Description of Artificial Sequence: Synthetic polypeptide"
ACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 3306 - protein, 455 aa, Artificial Sequence
  source: /note="Description of Artificial Sequence: Synthetic polypeptide"
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 3307 - protein, 5 aa, Artificial Sequence
  source: /note="Description of Artificial Sequence: Synthetic peptide"
GGGGS

SEQ ID NO: 3308 - protein, 10 aa, Artificial Sequence
  source: /note="Description of Artificial Sequence: Synthetic peptide"
GGGGSGGGGS

SEQ ID NO: 3309 - protein, 15 aa, Artificial Sequence
  source: /note="Description of Artificial Sequence: Synthetic peptide"
GGGGSGGGGSGGGGS

SEQ ID NO: 3310 - protein, 17 aa, Artificial Sequence
  source: /note="Description of Artificial Sequence: Synthetic peptide"
DVPSGPGGGGGSGGGGS

SEQ ID NO: 3311 - protein, 455 aa, Artificial Sequence; identical to SEQ ID NO: 3306
  source: /note="Description of Artificial Sequence: Synthetic polypeptide"

SEQ ID NO: 3312 - protein, 413 aa, Artificial Sequence
  source: /note="Description of Artificial Sequence: Synthetic polypeptide"
FRGPLLPNRPFTTVWNANTQWCLERHGVDVDVSVFDVVANPGQTFRGPDMTIFYSSQGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 3313 - protein, 551 aa, Artificial Sequence
  source: /note="Description of Artificial Sequence: Synthetic polypeptide"
YNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 3314 - protein, 14 aa, Artificial Sequence
  source: /note="Description of Artificial Sequence: Synthetic peptide"
AEAAAKEAAAKAAA

SEQ ID NO: 3315 - protein, 19 aa, Artificial Sequence
  source: /note="Description of Artificial Sequence: Synthetic peptide"
AEAAAKEAAAKEAAAKAAA

SEQ ID NO: 3316 - protein, 24 aa, Artificial Sequence
  source: /note="Description of Artificial Sequence: Synthetic peptide"
AEAAAKEAAAKEAAAKEAAAKAAA

SEQ ID NO: 3317 - protein, 29 aa, Artificial Sequence
  source: /note="Description of Artificial Sequence: Synthetic peptide"
AEAAAKEAAAKEAAAKEAAAKEAAAKAAA

SEQ ID NO: 3318-3376 - skipped (59 entries)

SEQ ID NO: 3377 - protein, 107 aa, Artificial Sequence; identical to SEQ ID NO: 93
  source: /note="Description of Artificial Sequence: Synthetic polypeptide"

SEQ ID NO: 3378 - protein, 107 aa, Artificial Sequence; identical to SEQ ID NO: 117
  source: /note="Description of Artificial Sequence: Synthetic polypeptide"

SEQ ID NO: 3379 - protein, 107 aa, Artificial Sequence; identical to SEQ ID NO: 199
  source: /note="Description of Artificial Sequence: Synthetic polypeptide"

SEQ ID NO: 3380 - protein, 107 aa, Artificial Sequence; identical to SEQ ID NO: 181
  source: /note="Description of Artificial Sequence: Synthetic polypeptide"

SEQ ID NO: 3381 - protein, 107 aa, Artificial Sequence; identical to SEQ ID NO: 87
  source: /note="Description of Artificial Sequence: Synthetic polypeptide"

SEQ ID NO: 3382 - protein, 107 aa, Artificial Sequence; identical to SEQ ID NO: 160
  source: /note="Description of Artificial Sequence: Synthetic polypeptide"

SEQ ID NO: 3383 - protein, 107 aa, Artificial Sequence; identical to SEQ ID NO: 147
  source: /note="Description of Artificial Sequence: Synthetic polypeptide"

SEQ ID NO: 3384 - protein, 107 aa, Artificial Sequence; identical to SEQ ID NO: 141
  source: /note="Description of Artificial Sequence: Synthetic polypeptide"

SEQ ID NO: 3385 - protein, 107 aa, Artificial Sequence; identical to SEQ ID NO: 81
  source: /note="Description of Artificial Sequence: Synthetic polypeptide"

SEQ ID NO: 3386 - protein, 107 aa, Artificial Sequence; identical to SEQ ID NO: 90
  source: /note="Description of Artificial Sequence: Synthetic polypeptide"

SEQ ID NO: 3387 - protein, 107 aa, Artificial Sequence; identical to SEQ ID NO: 102
  source: /note="Description of Artificial Sequence: Synthetic polypeptide"

SEQ ID NO: 3388 - protein, 107 aa, Artificial Sequence; identical to SEQ ID NO: 99
  source: /note="Description of Artificial Sequence: Synthetic polypeptide"

SEQ ID NO: 3389 - protein, 107 aa, Artificial Sequence; identical to SEQ ID NO: 108
  source: /note="Description of Artificial Sequence: Synthetic polypeptide"

SEQ ID NO: 3390 - protein, 119 aa, Artificial Sequence; identical to SEQ ID NO: 221
  source: /note="Description of Artificial Sequence: Synthetic polypeptide"

SEQ ID NO: 3391 - protein, 119 aa, Artificial Sequence; identical to SEQ ID NO: 223
  source: /note="Description of Artificial Sequence: Synthetic polypeptide"

SEQ ID NO: 3392 - protein, 119 aa, Artificial Sequence; identical to SEQ ID NO: 225
  source: /note="Description of Artificial Sequence: Synthetic polypeptide"

SEQ ID NO: 3393 - protein, 119 aa, Artificial Sequence; identical to SEQ ID NO: 219
  source: /note="Description of Artificial Sequence: Synthetic polypeptide"

SEQ ID NO: 3394 - protein, 119 aa, Artificial Sequence; identical to SEQ ID NO: 217
  source: /note="Description of Artificial Sequence: Synthetic polypeptide"

SEQ ID NO: 3395 - protein, 119 aa, Artificial Sequence; identical to SEQ ID NO: 211
  source: /note="Description of Artificial Sequence: Synthetic polypeptide"

SEQ ID NO: 3396 - protein, 119 aa, Artificial Sequence; identical to SEQ ID NO: 215
  source: /note="Description of Artificial Sequence: Synthetic polypeptide"

SEQ ID NO: 3397 - protein, 119 aa, Artificial Sequence; identical to SEQ ID NO: 213
  source: /note="Description of Artificial Sequence: Synthetic polypeptide"

SEQ ID NO: 3398 - protein, 119 aa, Artificial Sequence; identical to SEQ ID NO: 207
  source: /note="Description of Artificial Sequence: Synthetic polypeptide"

SEQ ID NO: 3399 - protein, 119 aa, Artificial Sequence; identical to SEQ ID NO: 209
  source: /note="Description of Artificial Sequence: Synthetic polypeptide"

SEQ ID NO: 3400 - protein, 119 aa, Artificial Sequence; identical to SEQ ID NO: 121
  source: /note="Description of Artificial Sequence: Synthetic polypeptide"

SEQ ID NO: 3401 - protein, 119 aa, Artificial Sequence; identical to SEQ ID NO: 182
  source: /note="Description of Artificial Sequence: Synthetic polypeptide"

SEQ ID NO: 3402 - protein, 119 aa, Artificial Sequence; identical to SEQ ID NO: 176
  source: /note="Description of Artificial Sequence: Synthetic polypeptide"

SEQ ID NO: 3403 - protein, 119 aa, Artificial Sequence; identical to SEQ ID NO: 158
  source: /note="Description of Artificial Sequence: Synthetic polypeptide"

SEQ ID NO: 3404 - protein, 119 aa, Artificial Sequence; identical to SEQ ID NO: 155
  source: /note="Description of Artificial Sequence: Synthetic polypeptide"

SEQ ID NO: 3405 - protein, 119 aa, Artificial Sequence; identical to SEQ ID NO: 118
  source: /note="Description of Artificial Sequence: Synthetic polypeptide"

SEQ ID NO: 3406 - protein, 119 aa, Artificial Sequence; identical to SEQ ID NO: 82
  source: /note="Description of Artificial Sequence: Synthetic polypeptide"

SEQ ID NO: 3407 - protein, 119 aa, Artificial Sequence; identical to SEQ ID NO: 106
  source: /note="Description of Artificial Sequence: Synthetic polypeptide"

SEQ ID NO: 3408 - protein, 119 aa, Artificial Sequence; identical to SEQ ID NO: 200
  source: /note="Description of Artificial Sequence: Synthetic polypeptide"

SEQ ID NO: 3409 - protein, 119 aa, Artificial Sequence; identical to SEQ ID NO: 124
  source: /note="Description of Artificial Sequence: Synthetic polypeptide"

SEQ ID NO: 3410 - protein, 119 aa, Artificial Sequence; identical to SEQ ID NO: 94
  source: /note="Description of Artificial Sequence: Synthetic polypeptide"

SEQ ID NO: 3411 - protein, 119 aa, Artificial Sequence; identical to SEQ ID NO: 151
  source: /note="Description of Artificial Sequence: Synthetic polypeptide"

SEQ ID NO: 3412 - protein, 119 aa, Artificial Sequence; identical to SEQ ID NO: 197
  source: /note="Description of Artificial Sequence: Synthetic polypeptide"

SEQ ID NO: 3413 - protein, 119 aa, Artificial Sequence; identical to SEQ ID NO: 130
  source: /note="Description of Artificial Sequence: Synthetic polypeptide"

SEQ ID NO: 3414 - protein, 119 aa, Artificial Sequence; identical to SEQ ID NO: 173
  source: /note="Description of Artificial Sequence: Synthetic polypeptide"

SEQ ID NO: 3415 - protein, 119 aa, Artificial Sequence; identical to SEQ ID NO: 142
  source: /note="Description of Artificial Sequence: Synthetic polypeptide"

SEQ ID NO: 3416 - protein, 119 aa, Artificial Sequence; identical to SEQ ID NO: 91
  source: /note="Description of Artificial Sequence: Synthetic polypeptide"

SEQ ID NO: 3417 - protein, 119 aa, Artificial Sequence; identical to SEQ ID NO: 139
  source: /note="Description of Artificial Sequence: Synthetic polypeptide"

SEQ ID NO: 3418 - protein, 119 aa, Artificial Sequence; identical to SEQ ID NO: 185
  source: /note="Description of Artificial Sequence: Synthetic polypeptide"

SEQ ID NO: 3419 - protein, 119 aa, Artificial Sequence; identical to SEQ ID NO: 133
  source: /note="Description of Artificial Sequence: Synthetic polypeptide"

SEQ ID NO: 3420 - protein, 119 aa, Artificial Sequence; identical to SEQ ID NO: 188
  source: /note="Description of Artificial Sequence: Synthetic polypeptide"

SEQ ID NO: 3421 - protein, 119 aa, Artificial Sequence; identical to SEQ ID NO: 109
  source: /note="Description of Artificial Sequence: Synthetic polypeptide"

SEQ ID NO: 3422 - protein, 119 aa, Artificial Sequence; identical to SEQ ID NO: 97
  source: /note="Description of Artificial Sequence: Synthetic polypeptide"

SEQ ID NO: 3423 - protein, 119 aa, Artificial Sequence; identical to SEQ ID NO: 85
  source: /note="Description of Artificial Sequence: Synthetic polypeptide"

SEQ ID NO: 3424 - protein, 119 aa, Artificial Sequence; identical to SEQ ID NO: 115
  source: /note="Description of Artificial Sequence: Synthetic polypeptide"

SEQ ID NO: 3425 - protein, 119 aa, Artificial Sequence; identical to SEQ ID NO: 191
  source: /note="Description of Artificial Sequence: Synthetic polypeptide"

SEQ ID NO: 3426 - protein, 119 aa, Artificial Sequence; identical to SEQ ID NO: 136
  source: /note="Description of Artificial Sequence: Synthetic polypeptide"

SEQ ID NO: 3427 - protein, 119 aa, Artificial Sequence; identical to SEQ ID NO: 203
  source: /note="Description of Artificial Sequence: Synthetic polypeptide"

SEQ ID NO: 3428 - protein, 119 aa, Artificial Sequence; identical to SEQ ID NO: 103
  source: /note="Description of Artificial Sequence: Synthetic polypeptide"

SEQ ID NO: 3429 - protein, 119 aa, Artificial Sequence; identical to SEQ ID NO: 205
  source: /note="Description of Artificial Sequence: Synthetic polypeptide"

SEQ ID NO: 3430 - protein, 119 aa, Artificial Sequence; identical to SEQ ID NO: 100
  source: /note="Description of Artificial Sequence: Synthetic polypeptide"

SEQ ID NO: 3431 - protein, 119 aa, Artificial Sequence; identical to SEQ ID NO: 179
  source: /note="Description of Artificial Sequence: Synthetic polypeptide"

SEQ ID NO: 3432 - protein, 119 aa, Artificial Sequence; identical to SEQ ID NO: 88
  source: /note="Description of Artificial Sequence: Synthetic polypeptide"

SEQ ID NO: 3433 - protein, 119 aa, Artificial Sequence; identical to SEQ ID NO: 167
  source: /note="Description of Artificial Sequence: Synthetic polypeptide"

SEQ ID NO: 3434 - protein, 119 aa, Artificial Sequence; identical to SEQ ID NO: 161
  source: /note="Description of Artificial Sequence: Synthetic polypeptide"

SEQ ID NO: 3435 - protein, 119 aa, Artificial Sequence; identical to SEQ ID NO: 145
  source: /note="Description of Artificial Sequence: Synthetic polypeptide"

SEQ ID NO: 3436 - protein, 119 aa, Artificial Sequence; identical to SEQ ID NO: 148
  source: /note="Description of Artificial Sequence: Synthetic polypeptide"

SEQ ID NO: 3437 - protein, 7 aa, Artificial Sequence
  source: /note="Description of Artificial Sequence: Synthetic peptide"
AEAAAKA

SEQ ID NO: 3438 - protein, 117 aa, Artificial Sequence
  source: /note="Description of Artificial Sequence: Synthetic polypeptide"
EVQLVESGGGLVQPGGSLRLSCAASGFTFSNFGMHWVRQAPGKGLEWVSYISSGSSTIYYADTLKGRFTISRDNAKNSLYLQMNSLRAEDTAVYYCARRGEGAMDYWGQGTTVTVSS

SEQ ID NO: 3439 - protein, 116 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVLGWFDYWGQGTLVTVSS

SEQ ID NO: 3440 - protein, 109 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGYPPDFTFGQGTKVEIK

SEQ ID NO: 3441 - protein, 119 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVAPYFAPFDYWGQGTLVTVSS

SEQ ID NO: 3442 - protein, 109 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGNPPLYTFGQGTKVEIK

SEQ ID NO: 3443 - protein, 116 aa, Artificial Sequence
  source: /note="Description of Artificial Sequence: Synthetic polypeptide"
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARNGYLGDYWGQGTLVTVSS

SEQ ID NO: 3444 - protein, 111 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQAMQIPTFGQGTKVEIK

SEQ ID NO: 3445 - protein, 120 aa, Artificial Sequence
  source: /note="Description of Artificial Sequence: Synthetic polypeptide"
QVQLQQSGGGLVQPGGSLKLSCAASGIDFSRYWMSWVRRAPGKGLEWIGEINPDSSTINYAPSLKDKFIISRDNAKNTLYLQMSKVRSEDTALYYCASLYYDYGDAMDYWGQGTSVTVSS

SEQ ID NO: 3446 - protein, 108 aa, Artificial Sequence
  source: /note="Description of Artificial Sequence: Synthetic polypeptide"
DIVMTQSQRFMTTSVGDRVSVTCKASQSVDSNVAWYQQKPRQSPKALIFSASLRFSGVPARFTGSGSGTDFTLTISNLQSEDLAEYFCQQYNNYPLTFGAGTKLELKR

SEQ ID NO: 3447 - protein, 123 aa, Artificial Sequence
  source: /note="Description of Artificial Sequence: Synthetic polypeptide"
EVQLVESGGGLVKPGGSLRLSCAASGFTFGDYALSWFRQAPGKGLEWVGVSRSKAYGGTTDYAASVKGRFTISRDDSKSTAYLQMNSLKTEDTAVYYCASSGYSSGWTPFDYWGQGTLVTVSS

SEQ ID NO: 3448 - protein, 111 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIFNYHQRPSGVPDRFSGSKSGSSASLAISGLQSEDEADYYCAAWDDSLNGWVFGGGTKLTVLG

SEQ ID NO: 3449 - protein, 101 aa, Artificial Sequence
  source: /note="Description of Artificial Sequence: Synthetic polypeptide"
IAGITQAPTSQILAAGRRMTLRCTQDMRHNAMYWYRQDLGLGLRLIHYSNTAGTTGKGEVPDGYSVSRANTDDFPLTLASAVPSQTSVYFCASSWSFGTEA

SEQ ID NO: 3450 - protein, 100 aa, Artificial Sequence
  source: /note="Description of Artificial Sequence: Synthetic polypeptide"
GVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYVGNTGEL

SEQ ID NO: 3451 - protein, 100 aa, Artificial Sequence
  source: /note="Description of Artificial Sequence: Synthetic polypeptide"
KVTQSSRYLVKRTGEKVFLECVQDMDHENMFWYRQDPGLGLRLIYFSYDVKMKEKGDIPEGYSVSREKKERFSLILASASTDQTSMYLCASSFLGTGVEQ

SEQ ID NO: 3452 - protein, 100 aa, Artificial Sequence
  source: /note="Description of Artificial Sequence: Synthetic polypeptide"
GGITQSPKYLFRKEGQNVTLSCEQNLNHDAMYWYRQDPGQGLRLIYYSQIVNDFQKGDIAEGYSVSREKKESFPLTVTSAQKNPTAFYLCASSSRSSYEQ

SEQ ID NO: 3453 - protein, 101 aa, Artificial Sequence
  source: /note="Description of Artificial Sequence: Synthetic polypeptide"
GVTQTPKHLITATGQRVTLRCSPRSGDLSVYWYQQSLDQGLQFLIQYYNGEERAKGNILERFSAQQFPDLHSELNLSSLELGDSALYFCASSVAGTPSYEQ

SEQ ID NO: 3454 - protein, 100 aa, Artificial Sequence
  source: /note="Description of Artificial Sequence: Synthetic polypeptide"
AGVTQTPRYLIKTRGQQVTLSCSPISGHRSVSWYQQTPGQGLQFLFEYFSETQRNKGNFPGRFSGRQFSNSRSEMNVSTLELGDSALYLCASSFNMATGQ

SEQ ID NO: 3455 - protein, 99 aa, Artificial Sequence
  source: /note="Description of Artificial Sequence: Synthetic polypeptide"
AVVSQHPSRVIVKSGTSVKIECRSLDFQATTMFWYRQFPSLMLMATSNEGSKATYEQGVEKDKFLINHASLTLSTLTVTSAHPEDSGFYICSALAGDTQ

SEQ ID NO: 3456 - protein, 106 aa, Artificial Sequence
  source: /note="Description of Artificial Sequence: Synthetic polypeptide"
MDAGVIQSPRHEVTEMGQQVTLRCKPISGHDYLFWYRQTMMRGLELLIYFNNNVPIDDSGMPEDRFSAKMPNASFSTLKIQPSEPRDSAVYFCASSLWEKLAKNIQ

SEQ ID NO: 3457 - protein, 28 aa, Artificial Sequence
  source: /note="Description of Artificial Sequence: Synthetic peptide"
DTGITQTPKYLVTAMGSKRTMKREHLGH

SEQ ID NO: 3458 - protein, 22 aa, Artificial Sequence
  source: /note="Description of Artificial Sequence: Synthetic peptide"
DSMYWYRQKAKKSLEFMFYYNC

SEQ ID NO: 3459 - protein, 44 aa, Artificial Sequence
  source: /note="Description of Artificial Sequence: Synthetic polypeptide"
KEFIENKTVPNHFTPECPDSSRLYLHVVALQQEDSAAYLCTSSQ

SEQ ID NO: 3460 - protein, 29 aa, Artificial Sequence
  source: /note="Description of Artificial Sequence: Synthetic peptide"
EPEVTQTPSHQVTQMGQEVILRCVPISNH

SEQ ID NO: 3461 - protein, 22 aa, Artificial Sequence
  source: /note="Description of Artificial Sequence: Synthetic peptide"
LYFYWYRQILGQKVEFLVSFYN

SEQ ID NO: 3462 - protein, 45 aa, Artificial Sequence
  source: /note="Description of Artificial Sequence: Synthetic polypeptide"
NEISEKSEIFDDQFSVERPDGSNFTLKIRSTKLEDSAMYFCASSE

SEQ ID NO: 3463 - protein, 29 aa, Artificial Sequence
  source: /note="Description of Artificial Sequence: Synthetic peptide"
DTAVSQTPKYLVTQMGNDKSIKCEQNLGH

SEQ ID NO: 3464 - protein, 22 aa, Artificial Sequence
  source: /note="Description of Artificial Sequence: Synthetic peptide"
DTMYWYKQDSKKFLKIMFSYNN

SEQ ID NO: 3465 - protein, 44 aa, Artificial Sequence
  source: /note="Description of Artificial Sequence: Synthetic polypeptide"
KELIINETVPNRFSPKSPDKAHLNLHINSLELGDSAVYFCASSQ

SEQ ID NO: 3466 - protein, 22 aa, Artificial Sequence
  source: /note="Description of Artificial Sequence: Synthetic peptide"
DTAVSQTPKYLVTQMGKKESLK

SEQ ID NO: 3467 - protein, 6 aa, Artificial Sequence
  source: /note="Description of Artificial Sequence: Synthetic peptide"
EQNLGH

SEQ ID NO: 3468 - protein, 22 aa, Artificial Sequence
  source: /note="Description of Artificial Sequence: Synthetic peptide"
NAMYWYKQDSKKFLKTMFIYSN

SEQ ID NO: 3469 - protein, 44 aa, Artificial Sequence
  source: /note="Description of Artificial Sequence: Synthetic polypeptide"
KEPILNETVPNRFSPDSPDKAHLNLHINSLELGDSAVYFCASSQ

SEQ ID NO: 3470 - protein, 29 aa, Artificial Sequence
  source: /note="Description of Artificial Sequence: Synthetic peptide"
DTEVTQTPKHLVMGMTNKKSLKCEQHMGH

SEQ ID NO: 3471 - protein, 22 aa, Artificial Sequence
  source: /note="Description of Artificial Sequence: Synthetic peptide"
RAMYWYKQKAKKPPELMFVYSY

SEQ ID NO: 3472 - protein, 44 aa, Artificial Sequence
  source: /note="Description of Artificial Sequence: Synthetic polypeptide"
EKLSINESVPSRFSPECPNSSLLNLHLHALQPEDSALYLCASSQ

SEQ ID NO: 3473 - protein, 29 aa, Artificial Sequence
  source: /note="Description of Artificial Sequence: Synthetic peptide"
ETGVTQTPRHLVMGMTNKKSLKCEQHLGH

SEQ ID NO: 3474 - protein, 22 aa, Artificial Sequence
  source: /note="Description of Artificial Sequence: Synthetic peptide"
NAMYWYKQSAKKPLELMFVYNF

SEQ ID NO: 3475 - protein, 44 aa, Artificial Sequence
  source: /note="Description of Artificial Sequence: Synthetic polypeptide"
KEQTENNSVPSRFSPECPNSSHLFLHLHTLQPEDSALYLCASSQ

SEQ ID NO: 3476 - protein, 29 aa, Artificial Sequence
  source: /note="Description of Artificial Sequence: Synthetic peptide"
ETGVTQTPRHLVMGMTNKKSLKCEQHLGH

SEQ ID NO: 3477 - protein, 22 aa, Artificial Sequence
  source: /note="Description of Artificial Sequence: Synthetic peptide"
NAMYWYKQSAKKPLELMFVYSL

SEQ ID NO: 3478 - protein, 44 aa, Artificial Sequence
  source: /note="Description of Artificial Sequence: Synthetic polypeptide"
EERVENNSVPSRFSPECPNSSHLFLHLHTLQPEDSALYLCASSQ

SEQ ID NO: 3479 - protein, 29 aa, Artificial Sequence
  source: /note="Description of Artificial Sequence: Synthetic peptide"
KAGVTQTPRYLIKTRGQQVTLSCSPISGH

SEQ ID NO: 3480 - protein, 22 aa, Artificial Sequence
  source: /note="Description of Artificial Sequence: Synthetic peptide"
RSVSWYQQTPGQGLQFLFEYFS

SEQ ID NO: 3481 - protein, 44 aa, Artificial Sequence
  source: /note="Description of Artificial Sequence: Synthetic polypeptide"
ETQRNKGNFPGRFSGRQFSNSRSEMNVSTLELGDSALYLCASSL

SEQ ID NO: 3482 - protein, 29 aa, Artificial Sequence
  source: /note="Description of Artificial Sequence: Synthetic peptide"
EAGVTQSPTHLIKTRGQQVTLRCSPISGH

SEQ ID NO: 3483 - protein, 22 aa, Artificial Sequence
  source: /note="Description of Artificial Sequence: Synthetic peptide"
SSVSWYQQAPGQGPQFIFEYAN

SEQ ID NO: 3484 - protein, 44 aa, Artificial Sequence
  source: /note="Description of Artificial Sequence: Synthetic polypeptide"
ELRRSEGNFPNRFSGRQFHDCCSEMNVSALELGDSALYLCARSL

SEQ ID NO: 3485 - protein, 29 aa, Artificial Sequence
  source: /note="Description of Artificial Sequence: Synthetic peptide"
ETGVTQSPTHLIKTRGQQVTLRCSSQSGH

SEQ ID NO: 3486 - protein, 22 aa, Artificial Sequence
  source: /note="Description of Artificial Sequence: Synthetic peptide"
NTVSWYQQALGQGPQFIFQYYR

SEQ ID NO: 3487 - protein, 44 aa, Artificial Sequence
  source: /note="Description of Artificial Sequence: Synthetic polypeptide"
EEENGRGNFPPRFSGLQFPNYSSELNVNALELDDSALYLCASSL

SEQ ID NO: 3488 - protein, 29 aa, Artificial Sequence
  source: /note="Description of Artificial Sequence: Synthetic peptide"
DAGVTQSPTHLIKTRGQQVTLRCSPISGH

SEQ ID NO: 3489 - protein, 22 aa, Artificial Sequence
  source: /note="Description of Artificial Sequence: Synthetic peptide"
KSVSWYQQVLGQGPQFIFQYYE

SEQ ID NO: 3490 - protein, 44 aa, Artificial Sequence
  source: /note="Description of Artificial Sequence: Synthetic polypeptide"
KEERGRGNFPDRFSARQFPNYSSELNVNALLLGDSALYLCASSL

SEQ ID NO: 3491 - protein, 29 aa, Artificial Sequence
  source: /note="Description of Artificial Sequence: Synthetic peptide"
DAGVTQSPTHLIKTRGQQVTLRCSPKSGH

SEQ ID NO: 3492 - protein, 22 aa, Artificial Sequence
  source: /note="Description of Artificial Sequence: Synthetic peptide"
DTVSWYQQALGQGPQFIFQYYE

SEQ ID NO: 3493 - protein, 44 aa, Artificial Sequence
  source: /note="Description of Artificial Sequence: Synthetic polypeptide"
EEERQRGNFPDRFSGHQFPNYSSELNVNALLLGDSALYLCASSL

SEQ ID NO: 3494 - protein, 29 aa, Artificial Sequence
  source: /note="Description of Artificial Sequence: Synthetic peptide"
DAGVTQSPTHLIKTRGQHVTLRCSPISGH

SEQ ID NO: 3495 - protein, 22 aa, Artificial Sequence
  source: /note="Description of Artificial Sequence: Synthetic peptide"
TSVSSYQQALGQGPQFIFQYYE

SEQ ID NO: 3496 - protein, 44 aa, Artificial Sequence
  source: /note="Description of Artificial Sequence: Synthetic polypeptide"
KEERGRGNFPDQFSGHQFPNYSSELNVNALLLGDSALYLCASSL

SEQ ID NO: 3497 - protein, 29 aa, Artificial Sequence
  source: /note="Description of Artificial Sequence: Synthetic peptide"
EAGVTQSPTHLIKTRGQQATLRCSPISGH

SEQ ID NO: 3498 - protein, 22 aa, Artificial Sequence
  source: /note="Description of Artificial Sequence: Synthetic peptide"
TSVYWYQQALGLGLQFLLWYDE

SEQ ID NO: 3499 - protein, 44 aa, Artificial Sequence
  source: /note="Description of Artificial Sequence: Synthetic polypeptide"
GEERNRGNFPPRFSGRQFPNYSSELNVNALELEDSALYLCASSL

SEQ ID NO: 3500 - protein, 29 aa, Artificial Sequence
  source: /note="Description of Artificial Sequence: Synthetic peptide"
NAGVTQTPKFQVLKTGQSMTLQCAQDMNH

SEQ ID NO: 3501 - protein, 22 aa, Artificial Sequence
  source: /note="Description of Artificial Sequence: Synthetic peptide"
NSMYWYRQDPGMGLRLIYYSAS

SEQ ID NO: 3502 - protein, 44 aa, Artificial Sequence
  source: /note="Description of Artificial Sequence: Synthetic polypeptide"
EGTTDKGEVPNGYNVSRLNKREFSLRLESAAPSQTSVYFCASSE

SEQ ID NO: 3503 - protein, 29 aa, Artificial Sequence
  source: /note="Description of Artificial Sequence: Synthetic peptide"
NAGVTQTPKFRVLKTGQSMTLLCAQDMNH

SEQ ID NO: 3504 - protein, 22 aa, Artificial Sequence
  source: /note="Description of Artificial Sequence: Synthetic peptide"
EYMYWYRQDPGMGLRLIHYSVG

SEQ ID NO: 3505 - protein, 44 aa, Artificial Sequence
  source: /note="Description of Artificial Sequence: Synthetic polypeptide"
EGTTAKGEVPDGYNVSRLKKQNFLLGLESAAPSQTSVYFCASSY

SEQ ID NO: 3506 - protein, 29 aa, Artificial Sequence
  source: /note="Description of Artificial Sequence: Synthetic peptide"
NAGVTQTPKFRVLKTGQSMTLLCAQDMNH

SEQ ID NO: 3507 - protein, 22 aa, Artificial Sequence
  source: /note="Description of Artificial Sequence: Synthetic peptide"
EYMYWYRQDPGMGLRLIHYSVG

SEQ ID NO: 3508 - protein, 44 aa, Artificial Sequence; identical to SEQ ID NO: 3505
  source: /note="Description of Artificial Sequence: Synthetic polypeptide"

SEQ ID NO: 3509 - protein, 29 aa, Artificial Sequence
  source: /note="Description of Artificial Sequence: Synthetic peptide"
IAGITQAPTSQILAAGRRMTLRCTQDMRH

SEQ ID NO: 3510 - protein, 22 aa, Artificial Sequence
  source: /note="Description of Artificial Sequence: Synthetic peptide"
NAMYWYRQDLGLGLRLIHYSNT

SEQ ID NO: 3511 - protein, 44 aa, Artificial Sequence
  source: /note="Description of Artificial Sequence: Synthetic polypeptide"
AGTTGKGEVPDGYSVSRANTDDFPLTLASAVPSQTSVYFCASSD

SEQ ID NO: 3512 - protein, 29 aa, Artificial Sequence
  source: /note="Description of Artificial Sequence: Synthetic peptide"
NAGVTQTPKFQVLKTGQSMTLQCAQDMNH

SEQ ID NO: 3513 - protein, 22 aa, Artificial Sequence
  source: /note="Description of Artificial Sequence: Synthetic peptide"
EYMSWYRQDPGMGLRLIHYSVG

SEQ ID NO: 3514 - protein, 44 aa, Artificial Sequence
  source: /note="Description of Artificial Sequence: Synthetic polypeptide"
AGITDQGEVPNGYNVSRSTTEDFPLRLLSAAPSQTSVYFCASSY

SEQ ID NO: 3515 - protein, 29 aa, Artificial Sequence
  source: /note="Description of Artificial Sequence: Synthetic peptide"
NAGVTQTPKFRILKIGQSMTLQCTQDMNH

SEQ ID NO: 3516 - protein, 22 aa, Artificial Sequence
  source: /note="Description of Artificial Sequence: Synthetic peptide"
NYMYWYRQDPGMGLKLIYYSVG

SEQ ID NO: 3517 - protein, 44 aa, Artificial Sequence
  source: /note="Description of Artificial Sequence: Synthetic polypeptide"
AGITDKGEVPNGYNVSRSTTEDFPLRLELAAPSQTSVYFCASSY

SEQ ID NO: 3518 - protein, 29 aa, Artificial Sequence
  source: /note="Description of Artificial Sequence: Synthetic peptide"
NAGVTQTPKFHVLKTGQSMTLLCAQDMNH

SEQ ID NO: 3519 - protein, 22 aa, Artificial Sequence
  source: /note="Description of Artificial Sequence: Synthetic peptide"
EYMYRYRQDPGKGLRLIYYSVA

SEQ ID NO: 3520 - protein, 44 aa, Artificial Sequence
  source: /note="Description of Artificial Sequence: Synthetic polypeptide"
AALTDKGEVPNGYNVSRSNTEDFPLKLESAAPSQTSVYFCASSY

SEQ ID NO: 3521 - protein, 29 aa, Artificial Sequence
  source: /note="Description of Artificial Sequence: Synthetic peptide"
NAGVTQTPKFHILKTGQSMTLQCAQDMNH

SEQ ID NO: 3522 - protein, 22 aa, Artificial Sequence
  source: /note="Description of Artificial Sequence: Synthetic peptide"
GYMSWYRQDPGMGLRLIYYSAA

SEQ ID NO: 3523 - protein, 43 aa, Artificial Sequence
  source: /note="Description of Artificial Sequence: Synthetic polypeptide"
AGTTDKEVPNGYNVSRLNTEDFPLRLVSAAPSQTSVYLCASSY

SEQ ID NO: 3524 - protein, 29 aa, Artificial Sequence
  source: /note="Description of Artificial Sequence: Synthetic peptide"
NAGVTQTPKFHILKTGQSMTLQCAQDMNH

SEQ ID NO: 3525 - protein, 22 aa, Artificial Sequence
  source: /note="Description of Artificial Sequence: Synthetic peptide"
GYLSWYRQDPGMGLRRIHYSVA

SEQ ID NO: 3526 - protein, 44 aa, Artificial Sequence
  source: /note="Description of Artificial Sequence: Synthetic polypeptide"
AGITDKGEVPDGYNVSRSNTEDFPLRLESAAPSQTSVYFCASSY

SEQ ID NO: 3527 - protein, 29 aa, Artificial Sequence
  source: /note="Description of Artificial Sequence: Synthetic peptide"
GAGVSQSLRHKVAKKGKDVALRYDPISGH

SEQ ID NO: 3528 - protein, 22 aa, Artificial Sequence
  source: /note="Description of Artificial Sequence: Synthetic peptide"
NALYWYRQSLGQGLEFPIYFQG

SEQ ID NO: 3529 - protein, 45 aa, Artificial Sequence
  source: /note="Description of Artificial Sequence: Synthetic polypeptide"
KDAADKSGLPRDRFSAQRSEGSISTLKFQRTQQGDLAVYLCASSS

SEQ ID NO: 3530 - protein, 29 aa, Artificial Sequence
  source: /note="Description of Artificial Sequence: Synthetic peptide"
GAGVSQSPSNKVTEKGKDVELRCDPISGH

SEQ ID NO: 3531 - protein, 22 aa, Artificial Sequence
  source: /note="Description of Artificial Sequence: Synthetic peptide"
TALYWYRQSLGQGLEFLIYFQG

SEQ ID NO: 3532 - protein, 45 aa, Artificial Sequence
  source: /note="Description of Artificial Sequence: Synthetic polypeptide"
NSAPDKSGLPSDRFSAERTGGSVSTLTIQRTQQEDSAVYLCASSL

SEQ ID NO: 3533 - protein, 29 aa, Artificial Sequence
  source: /note="Description of Artificial Sequence: Synthetic peptide"
GAGVSQTPSNKVTEKGKYVELRCDPISGH

SEQ ID NO: 3534 - protein, 22 aa, Artificial Sequence
  source: /note="Description of Artificial Sequence: Synthetic peptide"
TALYWYRQSLGQGPEFLIYFQG

SEQ ID NO: 3535 - protein, 45 aa, Artificial Sequence
  source: /note="Description of Artificial Sequence: Synthetic polypeptide"
TGAADDSGLPNDRFFAVRPEGSVSTLKIQRTERGDSAVYLCASSL

SEQ ID NO: 3536 - protein, 29 aa, Artificial Sequence
  source: /note="Description of Artificial Sequence: Synthetic peptide"
GAGVSQSPRYKVAKRGRDVALRCDSISGH

SEQ ID NO: 3537 - protein, 22 aa, Artificial Sequence
  source: /note="Description of Artificial Sequence: Synthetic peptide"
VTLYWYRQTLGQGSEVLTYSQS

SEQ ID NO: 3538 - protein, 45 aa, Artificial Sequence
  source: /note="Description of Artificial Sequence: Synthetic polypeptide"
DAQRDKSGRPSGRFSAERPERSVSTLKIQRTEQGDSAVYLCASSL

SEQ ID NO: 3539 - protein, 29 aa, Artificial Sequence
  source: /note="Description of Artificial Sequence: Synthetic peptide"
GAGVSQSPRYKVTKRGQDVALRCDPISGH

SEQ ID NO: 3540 - protein, 22 aa, Artificial Sequence
  source: /note="Description of Artificial Sequence: Synthetic peptide"
VSLYWYRQALGQGPEFLTYFNY

SEQ ID NO: 3541 - protein, 45 aa, Artificial Sequence
  source: /note="Description of Artificial Sequence: Synthetic polypeptide"
EAQQDKSGLPNDRFSAERPEGSISTLTIQRTEQRDSAMYRCASSL

SEQ ID NO: 3542 - protein, 29 aa, Artificial Sequence
  source: /note="Description of Artificial Sequence: Synthetic peptide"
GAGVSQSPRYKVTKRGQDVTLRCDPISSH

SEQ ID NO: 3543 - protein, 22 aa, Artificial Sequence
  source: /note="Description of Artificial Sequence: Synthetic peptide"
ATLYWYQQALGQGPEFLTYFNY

SEQ ID NO: 3544 - protein, 45 aa, Artificial Sequence
  source: /note="Description of Artificial Sequence: Synthetic polypeptide"
EAQPDKSGLPSDRFSAERPEGSISTLTIQRTEQRDSAMYRCASSL

SEQ ID NO: 3545 - protein, 29 aa, Artificial Sequence
  source: /note="Description of Artificial Sequence: Synthetic peptide"
GAGVSQSPRYKVAKRGQDVALRCDPISGH

SEQ ID NO: 3546 - protein, 22 aa, Artificial Sequence
  source: /note="Description of Artificial Sequence: Synthetic peptide"
VSLFWYQQALGQGPEFLTYFQN

SEQ ID NO: 3547 - protein, 45 aa, Artificial Sequence
  source: /note="Description of Artificial Sequence: Synthetic polypeptide"
EAQLDKSGLPSDRFFAERPEGSVSTLKIQRTQQEDSAVYLCASSL

SEQ ID NO: 3548 - protein, 29 aa, Artificial Sequence
  source: /note="Description of Artificial Sequence: Synthetic peptide"
DTGVSQNPRHKITKRGQNVTFRCDPISEH

SEQ ID NO: 3549 - protein, 22 aa, Artificial Sequence
  source: /note="Description of Artificial Sequence: Synthetic peptide"
NRLYWYRQTLGQGPEFLTYFQN

SEQ ID NO: 3550 - protein, 45 aa, Artificial Sequence
  source: /note="Description of Artificial Sequence: Synthetic polypeptide"
EAQLEKSRLLSDRFSAERPKGSFSTLEIQRTEQGDSAMYLCASSL

SEQ ID NO: 3551 - protein, 29 aa, Artificial Sequence
  source: /note="Description of Artificial Sequence: Synthetic peptide"
DSGVTQTPKHLITATGQRVTLRCSPRSGD

SEQ ID NO: 3552 - protein, 22 aa, Artificial Sequence
  source: /note="Description of Artificial Sequence: Synthetic peptide"
LSVYWYQQSLDQGLQFLIQYYN

SEQ ID NO: 3553 - protein, 44 aa, Artificial Sequence
  source: /note="Description of Artificial Sequence: Synthetic polypeptide"
GEERAKGNILERFSAQQFPDLHSELNLSSLELGDSALYFCASSV

SEQ ID NO: 3554 - protein, 29 aa, Artificial Sequence
  source: /note="Description of Artificial Sequence: Synthetic peptide"
DAEITQSPRHKITETGRQVTLACHQTWNH

SEQ ID NO: 3555 - protein, 22 aa, Artificial Sequence
  source: /note="Description of Artificial Sequence: Synthetic peptide"
NNMFWYRQDLGHGLRLIHYSYG

SEQ ID NO: 3556 - protein, 44 aa, Artificial Sequence
  source: /note="Description of Artificial Sequence: Synthetic polypeptide"
VQDTNKGEVSDGYSVSRSNTEDLPLTLESAASSQTSVYFCASSE

SEQ ID NO: 3557 - protein, 29 aa, Artificial Sequence
  source: /note="Description of Artificial Sequence: Synthetic peptide"
DAGITQSPRYKITETGRQVTLMCHQTWSH

SEQ ID NO: 3558 - protein, 22 aa, Artificial Sequence
  source: /note="Description of Artificial Sequence: Synthetic peptide"
SYMFWYRQDLGHGLRLIYYSAA

SEQ ID NO: 3559 - protein, 44 aa, Artificial Sequence
  source: /note="Description of Artificial Sequence: Synthetic polypeptide"
ADITDKGEVPDGYVVSRSKTENFPLTLESATRSQTSVYFCASSE

SEQ ID NO: 3560 - protein, 29 aa, Artificial Sequence
  source: /note="Description of Artificial Sequence: Synthetic peptide"
DAGITQSPRHKVTETGTPVTLRCHQTENH

SEQ ID NO: 3561 - protein, 22 aa, Artificial Sequence
  source: /note="Description of Artificial Sequence: Synthetic peptide"
RYMYWYRQDPGHGLRLIHYSYG

SEQ ID NO: 3562 - protein, 44 aa, Artificial Sequence
  source: /note="Description of Artificial Sequence: Synthetic polypeptide"
VKDTDKGEVSDGYSVSRSKTEDFLLTLESATSSQTSVYFCAISE

SEQ ID NO: 3563 - protein, 29 aa, Artificial Sequence
  source: /note="Description of Artificial Sequence: Synthetic peptide"
EAEVAQSPRYKITEKSQAVAFWCDPISGH

SEQ ID NO: 3564 - protein, 22 aa, Artificial Sequence
  source: /note="Description of Artificial Sequence: Synthetic peptide"
ATLYWYRQILGQGPELLVQFQD

SEQ ID NO: 3565 - protein, 45 aa, Artificial Sequence
  source: /note="Description of Artificial Sequence: Synthetic polypeptide"
ESVVDDSQLPKDRFSAERLKGVDSTLKIQPAELGDSAMYLCASSL

SEQ ID NO: 3566 - protein, 29 aa, Artificial Sequence
  source: /note="Description of Artificial Sequence: Synthetic peptide"
EAGVAQSPRYKIIEKRQSVAFWCNPISGH

SEQ ID NO: 3567 - protein, 22 aa, Artificial Sequence
  source: /note="Description of Artificial Sequence: Synthetic peptide"
ATLYWYQQILGQGPKLLIQFQN

SEQ ID NO: 3568 - protein, 45 aa, Artificial Sequence
  source: /note="Description of Artificial Sequence: Synthetic polypeptide"
NGVVDDSQLPKDRFSAERLKGVDSTLKIQPAKLEDSAVYLCASSL

SEQ ID NO: 3569 - protein, 29 aa, Artificial Sequence
  source: /note="Description of Artificial Sequence: Synthetic peptide"
EAGVVQSPRYKIIEKKQPVAFWCNPISGH

SEQ ID NO: 3570 - protein, 22 aa, Artificial Sequence
  source: /note="Description of Artificial Sequence: Synthetic peptide"
NTLYWYLQNLGQGPELLIRYEN

SEQ ID NO: 3571 - protein, 45 aa, Artificial Sequence
  source: /note="Description of Artificial Sequence: Synthetic polypeptide"
EEAVDDSQLPKDRFSAERLKGVDSTLKIQPAELGDSAVYLCASSL

SEQ ID NO: 3572 - protein, 29 aa, Artificial Sequence
  source: /note="Description of Artificial Sequence: Synthetic peptide"
DAGVIQSPRHKVTEMGQSVTLRCEPISGH

SEQ ID NO: 3573 - protein, 22 aa, Artificial Sequence
  source: /note="Description of Artificial Sequence: Synthetic peptide"
NDLLWYRQTFVQGLELLNYFCS

SEQ ID NO: 3574 - protein, 12 aa, Artificial Sequence
  source: /note="Description of Artificial Sequence: Synthetic peptide"
WTLVDDSGVSKD

SEQ ID NO: 3575 - protein, 32 aa, Artificial Sequence
  source: /note="Description of Artificial Sequence: Synthetic polypeptide"
FSAQMPDVSFSTLRIQPMEPRDLGLYFCASSF

SEQ ID NO: 3576 - protein, 29 aa, Artificial Sequence
  source: /note="Description of Artificial Sequence: Synthetic peptide"
DAGIIQSPKHEVTEMGQTVTLRCEPIFGH

SEQ ID NO: 3577 - protein, 22 aa, Artificial Sequence
  source: /note="Description of Artificial Sequence: Synthetic peptide"
NFLFWYRDTFVQGLELLSYFRS

SEQ ID NO: 3578 - protein, 44 aa, Artificial Sequence
  source: /note="Description of Artificial Sequence: Synthetic polypeptide"
SIIDNAGMPTERFSAERPDGSFSTLKIQPAEQGDSAVYVCASRL

SEQ ID NO: 3579 - protein, 29 aa, Artificial Sequence
  source: /note="Description of Artificial Sequence: Synthetic peptide"
DAGVIQSPRHEVTEMGQEVTLRCKPISGH

SEQ ID NO: 3580 - protein, 22 aa, Artificial Sequence
  source: /note="Description of Artificial Sequence: Synthetic peptide"
NSLFWYRQTMMRGLELLIYFNN

SEQ ID NO: 3581 - protein, 45 aa, Artificial Sequence
  source: /note="Description of Artificial Sequence: Synthetic polypeptide"
NVPIDDSGMPEDRFSAKMPNASFSTLKIQPSEPRDSAVYFCASSL

SEQ ID NO: 3582 - protein, 29 aa, Artificial Sequence
  source: /note="Description of Artificial Sequence: Synthetic peptide"
DAGVIQSPRHEVTEMGQEVTLRCKPISGH

SEQ ID NO: 3583 - protein, 22 aa, Artificial Sequence
  source: /note="Description of Artificial Sequence: Synthetic peptide"
DYLFWYRQTMMRGLELLIYFNN

SEQ ID NO: 3584 - protein, 45 aa, Artificial Sequence; identical to SEQ ID NO: 3581
  source: /note="Description of Artificial Sequence: Synthetic polypeptide"

SEQ ID NO: 3585 - protein, 29 aa, Artificial Sequence
  source: /note="Description of Artificial Sequence: Synthetic peptide"
DARVTQTPRHKVTEMGQEVTMRCQPILGH

SEQ ID NO: 3586 - protein, 22 aa, Artificial Sequence
  source: /note="Description of Artificial Sequence: Synthetic peptide"
NTVFWYRQTMMQGLELLAYFRN

SEQ ID NO: 3587 - protein, 45 aa, Artificial Sequence
  source: /note="Description of Artificial Sequence: Synthetic polypeptide"
RAPLDDSGMPKDRFSAEMPDATLATLKIQPSEPRDSAVYFCASGL

SEQ ID NO: 3588 - protein, 29 aa, Artificial Sequence
  source: /note="Description of Artificial Sequence: Synthetic peptide"
AAGVIQSPRHLIKEKRETATLKCYPIPRH

SEQ ID NO: 3589 - protein, 22 aa, Artificial Sequence
  source: /note="Description of Artificial Sequence: Synthetic peptide"
DTVYWYQQGPGQDPQFLISFYE

SEQ ID NO: 3590 - protein, 44 aa, Artificial Sequence
  source: /note="Description of Artificial Sequence: Synthetic polypeptide"
KMQSDKGSIPDRFSAQQFSDYHSELNMSSLELGDSALYFCASSL

SEQ ID NO: 3591 - protein, 29 aa, Artificial Sequence
  source: /note="Description of Artificial Sequence: Synthetic peptide"
EAGVTQFPSHSVIEKGQTVTLRCDPISGH

SEQ ID NO: 3592 - protein, 22 aa, Artificial Sequence
  source: /note="Description of Artificial Sequence: Synthetic peptide"
DNLYWYRRVMGKEIKFLLHFVK

SEQ ID NO: 3593 - protein, 45 aa, Artificial Sequence
  source: /note="Description of Artificial Sequence: Synthetic polypeptide"
ESKQDESGMPNNRFLAERTGGTYSTLKVQPAELEDSGVYFCASSQ

SEQ ID NO: 3594 - protein, 29 aa, Artificial Sequence
  source: /note="Description of Artificial Sequence: Synthetic peptide"
DAMVIQNPRYQVTQFGKPVTLSCSQTLNH

SEQ ID NO: 3595 - protein, 22 aa, Artificial Sequence
  source: /note="Description of Artificial Sequence: Synthetic peptide"
NVMYWYQQKSSQAPKLLFHYYD

SEQ ID NO: 3596 - protein, 44 aa, Artificial Sequence
  source: /note="Description of Artificial Sequence: Synthetic polypeptide"
KDFNNEADTPDNFQSRRPNTSFCFLDIRSPGLGDTAMYLCATSR

SEQ ID NO: 3597 - protein, 29 aa, Artificial Sequence
  source: /note="Description of Artificial Sequence: Synthetic peptide"
GEEVAQTPKHLVRGEGQKAKLYCAPIKGH

SEQ ID NO: 3598 - protein, 22 aa, Artificial Sequence
  source: /note="Description of Artificial Sequence: Synthetic peptide"
SYVFWYQQVLKNEFKFLISFQN

SEQ ID NO: 3599 - protein, 45 aa, Artificial Sequence
  source: /note="Description of Artificial Sequence: Synthetic polypeptide"
ENVFDETGMPKERFSAKCLPNSPCSLEIQATKLEDSAVYFCASSQ

SEQ ID NO: 3600 - protein, 29 aa, Artificial Sequence
  source: /note="Description of Artificial Sequence: Synthetic peptide"
EPGVSQTPRHKVTNMGQEVILRCDPSSGH

SEQ ID NO: 3601 - protein, 22 aa, Artificial Sequence
  source: /note="Description of Artificial Sequence: Synthetic peptide"
MFVHWYRQNLRQEMKLLISFQY

SEQ ID NO: 3602 - protein, 44 aa, Artificial Sequence
  source: /note="Description of Artificial Sequence: Synthetic polypeptide"
QNIAVDSGMPKERFTAERPNGTSSTLKIHPAEPRDSAVYLYSSG

SEQ ID NO: 3603 - protein, 29 aa, Artificial Sequence
  source: /note="Description of Artificial Sequence: Synthetic peptide"
NAGVMQNPRHLVRRRGQEARLRCSPMKGH

SEQ ID NO: 3604 - protein, 22 aa, Artificial Sequence
  source: /note="Description of Artificial Sequence: Synthetic peptide"
SHVYWYRQLPEEGLKFMVYLQK

SEQ ID NO: 3605 - protein, 45 aa, Artificial Sequence
  source: /note="Description of Artificial Sequence: Synthetic polypeptide"
ENIIDESGMPKERFSAEFPKEGPSILRIQQVVRGDSAAYFCASSP

SEQ ID NO: 3606 - protein, 29 aa, Artificial Sequence
  source: /note="Description of Artificial Sequence: Synthetic peptide"
DGGITQSPKYLFRKEGQNVTLSCEQNLNH

SEQ ID NO: 3607 - protein, 22 aa, Artificial Sequence
  source: /note="Description of Artificial Sequence: Synthetic peptide"
DAMYWYRQDPGQGLRLIYYSQI

SEQ ID NO: 3608 - protein, 44 aa, Artificial Sequence
  source: /note="Description of Artificial Sequence: Synthetic polypeptide"
VNDFQKGDIAEGYSVSREKKESFPLTVTSAQKNPTAFYLCASSI

SEQ ID NO: 3609 - protein, 29 aa, Artificial Sequence
  source: /note="Description of Artificial Sequence: Synthetic peptide"
GAVVSQHPSWVICKSGTSVKIECRSLDFQ

SEQ ID NO: 3610 - protein, 24 aa, Artificial Sequence
  source: /note="Description of Artificial Sequence: Synthetic peptide"
ATTMFWYRQFPKQSLMLMATSNEG

SEQ ID NO: 3611 - protein, 44 aa, Artificial Sequence
  source: /note="Description of Artificial Sequence: Synthetic polypeptide"
SKATYEQGVEKDKFLINHASLTLSTLTVTSAHPEDSSFYICSAR

SEQ ID NO: 3612 - protein, 29 aa, Artificial Sequence
  source: /note="Description of Artificial Sequence: Synthetic peptide"
DTKVTQRPRLLVKASEQKAKMDCVPIKAH

SEQ ID NO: 3613 - protein, 22 aa, Artificial Sequence
  source: /note="Description of Artificial Sequence: Synthetic peptide"
SYVYWYRKKLEEELKFLVYFQN

SEQ ID NO: 3614 - protein, 45 aa, Artificial Sequence
  source: /note="Description of Artificial Sequence: Synthetic polypeptide"
EELIQKAEIINERFLAQCSKNSSCTLEIQSTESGDTALYFCASSK

SEQ ID NO: 3615 - protein, 29 aa, Artificial Sequence
  source: /note="Description of Artificial Sequence: Synthetic peptide"
HAKVTQTPGHLVKGKGQKTKMDCTPEKGH

SEQ ID NO: 3616 - protein, 22 aa, Artificial Sequence
  source: /note="Description of Artificial Sequence: Synthetic peptide"
TFVYWYQQNQNKEFMLLISFQN

SEQ ID NO: 3617 - protein, 45 aa, Artificial Sequence
  source: /note="Description of Artificial Sequence: Synthetic polypeptide"
EQVLQETEMHKKRFSSQCPKNAPCSLAILSSEPGDTALYLCASSQ

SEQ ID NO: 3618 - protein, 29 aa, Artificial Sequence
  source: /note="Description of Artificial Sequence: Synthetic peptide"
DADVTQTPRNRITKTGKRIMLECSQTKGH

SEQ ID NO: 3619 - protein, 22 aa, Artificial Sequence
  source: /note="Description of Artificial Sequence: Synthetic peptide"
DRMYWYRQDPGLGLRLIYYSFD

SEQ ID NO: 3620 - protein, 45 aa, Artificial Sequence
  source: /note="Description of Artificial Sequence: Synthetic polypeptide"
VKDINKGEISDGYSVSRQAQAKFSLSLESAIPNQTALYFCATSDL

SEQ ID NO: 3621 - protein, 29 aa, Artificial Sequence
  source: /note="Description of Artificial Sequence: Synthetic peptide"
EADIYQTPRYLVIGTGKKITLECSQTMGH

SEQ ID NO: 3622 - protein, 22 aa, Artificial Sequence
  source: /note="Description of Artificial Sequence: Synthetic peptide"
DKMYWYQQDPGMELHLIHYSYG

SEQ ID NO: 3623 - protein, 44 aa, Artificial Sequence
  source: /note="Description of Artificial Sequence: Synthetic polypeptide"
VNSTEKGDLSSESTVSRIRTEHFPLTLESARPSHTSQYLCASSE

SEQ ID NO: 3624 - protein, 29 aa, Artificial Sequence
  source: /note="Description of Artificial Sequence: Synthetic peptide"
DAVVTQFPRHRIIGTGKEFILQCSQNMNH

SEQ ID NO: 3625 - protein, 22 aa, Artificial Sequence
  source: /note="Description of Artificial Sequence: Synthetic peptide"
VTMYWYRQDPGLGLKLVYYSPG

SEQ ID NO: 3626 - protein, 16 aa, Artificial Sequence
  source: /note="Description of Artificial Sequence: Synthetic peptide"
TGSTEKGDISEGYHVS

SEQ ID NO: 3627 - protein, 27 aa, Artificial Sequence
  source: /note="Description of Artificial Sequence: Synthetic peptide"
NTIASFPLTLKSASTNQTSVYLYASSS

SEQ ID NO: 3628 - protein, 29 aa, Artificial Sequence
  source: /note="Description of Artificial Sequence: Synthetic peptide"
EAQVTQNPRYLITVTGKKLTVTCSQNMNH

SEQ ID NO: 3629 - protein, 22 aa, Artificial Sequence
  source: /note="Description of Artificial Sequence: Synthetic peptide"
EYMSWYRQDPGLGLRQIYYSMN

SEQ ID NO: 3630 - protein, 44 aa, Artificial Sequence
  source: /note="Description of Artificial Sequence: Synthetic polypeptide"
VEVTDKGDVPEGYKVSRKEKRNFPLILESPSPNQTSLYFCASSL

SEQ ID NO: 3631 - protein, 29 aa, Artificial Sequence
  source: /note="Description of Artificial Sequence: Synthetic peptide"
DVKVTQSSRYLVKRTGEKVFLECVQDMDH

SEQ ID NO: 3632 - protein, 22 aa, Artificial Sequence
  source: /note="Description of Artificial Sequence: Synthetic peptide"
ENMFWYRQDPGLGLRLIYFSYD

SEQ ID NO: 3633 - protein, 44 aa, Artificial Sequence
  source: /note="Description of Artificial Sequence: Synthetic polypeptide"
VKMKEKGDIPEGYSVSREKKERFSLILESASTNQTSMYLCASSL

SEQ ID NO: 3634 - protein, 29 aa, Artificial Sequence
  source: /note="Description of Artificial Sequence: Synthetic peptide"
SAVISQKPSRDICQRGTSLTIQCQVDSQV

SEQ ID NO: 3635 - protein, 23 aa, Artificial Sequence
  source: /note="Description of Artificial Sequence: Synthetic peptide"
TMMFWYRQQPGQSLTLIATANQG

SEQ ID NO: 3636 - protein, 44 aa, Artificial Sequence
  source: /note="Description of Artificial Sequence: Synthetic polypeptide"
SEATYESGFVIDKFPISRPNLTFSTLTVSNMSPEDSSIYLCSVE

SEQ ID NO: 3637 - protein, 29 aa, Artificial Sequence
  source: /note="Description of Artificial Sequence: Synthetic peptide"
SQTIHQWPATLVQPVGSPLSLECTVEGTS

SEQ ID NO: 3638 - protein, 23 aa, Artificial Sequence
  source: /note="Description of Artificial Sequence: Synthetic peptide"
NPNLYWYRQAAGRGLQLLFYSVG

SEQ ID NO: 3639 - protein, 42 aa, Artificial Sequence
  source: /note="Description of Artificial Sequence: Synthetic polypeptide"
IGQISSEVPQNLSASRPQDRQFILSSKKLLLSDSGFYLCAWS

We claim:

1. A composition comprising a polypeptide molecule comprising an anti-T cell receptor beta variable chain (TCRβV) binding domain comprising:
   (i) a heavy chain variable region (VH) comprising a heavy chain complementarity determining region 1 (HC CDR1) sequence, a HC CDR2 sequence, and a HC CDR3 sequence of any one of SEQ ID NOs: 142, 155, 170, 185, and 197, wherein the HC CDR1 sequence, the HC CDR2 sequence, and the HC CDR3 sequence are determined according to the Kabat numbering scheme, the Chothia numbering scheme, or the ImMunoGeneTics Information System (IMGT); and
   (ii) a light chain variable region (VL) comprising a light chain complementarity determining region 1 (LC CDR1) sequence, a LC CDR2 sequence, and a LC CDR3 sequence of any one of SEQ ID NOs: 141, 154, 169, 184, and 196, wherein the LC CDR1 sequence, the LC CDR2 sequence, and the LC CDR3 sequence are determined according to the Kabat numbering scheme, the Chothia numbering scheme, or the ImMunoGeneTics Information System (IMGT).

2. The composition of claim 1, wherein the HC CDR1 sequence, the HC CDR2 sequence, and the HC CDR3 sequence are determined by the Kabat numbering scheme.

3. The composition of claim 1, wherein the HC CDR1 sequence, the HC CDR2 sequence, and the HC CDR3 sequence are determined by the Chothia numbering scheme.

4. The composition of claim 1, wherein the HC CDR1 sequence, the HC CDR2 sequence, and the HC CDR3 sequence are determined by IMGT.

5. The composition of claim 1, wherein the LC CDR1 sequence, the LC CDR2 sequence, and the LC CDR3 sequence are determined by the Kabat numbering scheme.

6. The composition of claim 1, wherein the LC CDR1 sequence, the LC CDR2 sequence, and the LC CDR3 sequence are determined by the Chothia numbering scheme.

7. The composition of claim 1, wherein the LC CDR1 sequence, the LC CDR2 sequence, and the LC CDR3 sequence are determined by IMGT.

8. The composition of claim 1, wherein the HC CDR1 sequence, the HC CDR2 sequence, and the HC CDR3 sequence are determined by the Kabat numbering scheme, and the LC CDR1 sequence, the LC CDR2 sequence, and the LC CDR3 sequence are determined by the Kabat numbering scheme.

9. The composition of claim 1, wherein the HC CDR1 sequence, the HC CDR2 sequence, and the HC CDR3 sequence are determined by the Chothia numbering scheme, and the LC CDR1 sequence, the LC CDR2 sequence, and the LC CDR3 sequence are determined by the Chothia numbering scheme.

10. The composition of claim 1, wherein the HC CDR1 sequence, the HC CDR2 sequence, and the HC CDR3 sequence are determined by IMGT, and the LC CDR1 sequence, the LC CDR2 sequence, and the LC CDR3 sequence are determined by IMGT.

11. The composition of claim 1, wherein the VH comprises the HC CDR1 sequence, the HC CDR2 sequence, and the HC CDR3 sequence of SEQ ID NO: 142.

12. The composition of claim 11, wherein the HC CDR1 sequence, the HC CDR2 sequence, and the HC CDR3 sequence are determined by the Chothia numbering scheme.

13. The composition of claim 1, wherein the VL comprises the LC CDR1 sequence, the LC CDR2 sequence, and the LC CDR3 sequence of SEQ ID NO: 141.

14. The composition of claim 12, wherein the VL comprises the LC CDR1 sequence, the LC CDR2 sequence, and the LC CDR3 sequence of SEQ ID NO: 141.

15. The composition of claim 1, wherein the VH comprises the HC CDR1 sequence, the HC CDR2 sequence, and the HC CDR3 sequence of SEQ ID NO: 155, 170, 185, or 197.

16. The composition of claim 14, wherein the LC CDR1 sequence, the LC CDR2 sequence, and the LC CDR3 sequence are determined by IMGT.

17. The composition of claim 15, wherein the VL comprises the LC CDR1 sequence, the LC CDR2 sequence, and the LC CDR3 sequence of SEQ ID NO: 154, and the VH comprises the HC CDR1 sequence, the HC CDR2 sequence, and the HC CDR3 sequence of SEQ ID NO: 155.

18. The composition of claim 15, wherein the VL comprises the LC CDR1 sequence, the LC CDR2 sequence, and the LC CDR3 sequence of SEQ ID NO: 169, and the VH comprises the HC CDR1 sequence, the HC CDR2 sequence, and the HC CDR3 sequence of SEQ ID NO: 170.

19. The composition of claim 15, wherein the VL comprises the LC CDR1 sequence, the LC CDR2 sequence, and the LC CDR3 sequence of SEQ ID NO: 184, and the VH comprises the HC CDR1 sequence, the HC CDR2 sequence, and the HC CDR3 sequence of SEQ ID NO: 185.

20. The composition of claim 15, wherein the VL comprises the LC CDR1 sequence, the LC CDR2 sequence, and the LC CDR3 sequence of SEQ ID NO: 196, and the VH comprises the HC CDR1 sequence, the HC CDR2 sequence, and the HC CDR3 sequence of SEQ ID NO: 197.

21. The composition of claim 1, wherein:
   (i) the VH comprises an amino acid sequence having at least 80% sequence identity to SEQ ID NO: 142, and the VL comprises an amino acid sequence having at least 80% sequence identity to SEQ ID NO: 141;
   (ii) the VH comprises an amino acid sequence having at least 80% sequence identity to SEQ ID NO: 155, and the VL comprises an amino acid sequence having at least 80% sequence identity to SEQ ID NO: 154;

(iii) the VH comprises an amino acid sequence having at least 80% sequence identity to SEQ ID NO: 170, and the VL comprises an amino acid sequence having at least 80% sequence identity to SEQ ID NO: 169;
(iv) the VH comprises an amino acid sequence having at least 80% sequence identity to SEQ ID NO: 185, and the VL comprises an amino acid sequence having at least 80% sequence identity to SEQ ID NO: 184; or
(v) the VH comprises an amino acid sequence having at least 80% sequence identity to SEQ ID NO: 197, and the VL comprises an amino acid sequence having at least 80% sequence identity to SEQ ID NO: 196.

22. The composition of claim 16, wherein the VH comprises an amino acid sequence having at least 80% sequence identity to SEQ ID NO: 142, and the VL comprises an amino acid sequence having at least 80% sequence identity to SEQ ID NO: 141.

23. The composition of claim 1, wherein the anti-TCRβV binding domain is a single chain Fv (scFv) comprising an amino acid sequence having at least 80% sequence identity to SEQ ID NO: 140, 153, 168, 183, or 195.

24. The composition of claim 1, wherein the anti-TCRβV binding domain is a scFv, a full-length antibody, a Fab, a F(ab')2, an Fv, a single chain Fv, a half arm antibody, a diabody, a bivalent antibody, a monovalent antibody, or a bi specific antibody.

25. The composition of claim 22, wherein the anti-TCRβV binding domain is a Fab.

26. The composition of claim 1, wherein the polypeptide molecule further comprises:
(i) a heavy chain constant region linked to the VH, wherein the heavy chain constant region is selected from the group consisting of a heavy chain constant region of IgG1, IgG2, IgG3, IgGA1, IgGA2, IgG4, IgJ, IgM, IgD, and IgE; and
(ii) a light chain constant region linked the VL, wherein the light chain constant region is a kappa light chain constant region, or a lambda light chain constant region.

27. The composition of claim 1, wherein the polypeptide molecule further comprises a targeting moiety, wherein the targeting moiety is a cytokine molecule, a tumor-targeting moiety, or a second anti-TCRβV binding domain.

28. The composition of claim 27, wherein the targeting moiety is a cytokine molecule selected from the group consisting of interleukin-2 (IL-2) or a functional fragment or a functional variant thereof, interleukin-7 (IL-7) or a functional fragment or a functional variant thereof, interleukin-12 (IL-12) or a functional fragment or a functional variant thereof, interleukin-15 (IL-15) or a functional fragment or a functional variant thereof, interleukin-18 (IL-18) or a functional fragment or a functional variant thereof, interleukin-21 (IL-21) or a functional fragment or a functional variant thereof, and interferon gamma or a functional fragment or a functional variant thereof.

29. The composition of claim 27, wherein the cytokine molecule is interleukin-2 (IL-2) or a functional fragment or a functional variant thereof.

30. The composition of claim 27, wherein the cytokine molecule is interleukin-15 (IL-15) or a functional fragment or a functional variant thereof.

31. The composition of claim 27, wherein the cytokine molecule is interleukin-21 (IL-21) or a functional fragment or a functional variant thereof.

32. The composition of claim 27, wherein the cytokine molecule comprises a sequence having at least 95% sequence identity to SEQ ID NO: 2170, 2180, 2191, 2270, 2280, or 2320.

33. A pharmaceutical composition comprising the composition of claim 1, and a pharmaceutically acceptable carrier, excipient, or diluent.

34. A method of treating cancer in a subject in need thereof comprising administering a therapeutically effective amount of the pharmaceutical composition of claim 33 to the subject, thereby treating the cancer in the subject.

\* \* \* \* \*